(12) United States Patent
Mrsny et al.

(10) Patent No.: US 11,324,833 B2
(45) Date of Patent: *May 10, 2022

(54) CHOLIX-DERIVED CARRIERS FOR ORAL DELIVERY OF HETEROLOGOUS PAYLOAD

(71) Applicant: Applied Molecular Transport Inc., South San Francisco, CA (US)

(72) Inventors: Randall J. Mrsny, Los Altos Hills, CA (US); Charles Olson, South San Francisco, CA (US); Sally Postlethwaite, Redwood City, CA (US); Thomas Carl Hunter, Mountain View, CA (US); Tahir Mahmood, Burlingame, CA (US); Weijun Feng, Danville, CA (US)

(73) Assignee: Applied Molecular Transport Inc., South San Francisco, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/884,456

(22) Filed: May 27, 2020

(65) Prior Publication Data

US 2021/0100911 A1  Apr. 8, 2021

Related U.S. Application Data

(63) Continuation of application No. PCT/US2019/050708, filed on Sep. 11, 2019.

(60) Provisional application No. 62/888,133, filed on Aug. 16, 2019, provisional application No. 62/888,144, filed on Aug. 16, 2019, provisional application No. 62/888,400, filed on Aug. 16, 2019, provisional application No. 62/816,022, filed on Mar. 8, 2019, provisional application No. 62/756,889, filed on Nov. 7, 2018.

(51) Int. Cl.
| | |
|---|---|
| *A61K 39/02* | (2006.01) |
| *A61K 47/64* | (2017.01) |
| *C07K 14/28* | (2006.01) |
| *C07K 14/195* | (2006.01) |

(52) U.S. Cl.
CPC ........ *A61K 47/6415* (2017.08); *A61K 39/107* (2013.01); *C07K 14/195* (2013.01)

(58) Field of Classification Search
None
See application file for complete search history.

(56) References Cited

U.S. PATENT DOCUMENTS

| | | | |
|---|---|---|---|
| 4,569,789 A | 2/1986 | Blattler et al. | |
| 4,671,958 A | 6/1987 | Rodwell et al. | |
| 4,680,338 A | 7/1987 | Sundoro | |
| 5,328,984 A | 7/1994 | Pastan et al. | |
| 5,512,658 A | 4/1996 | Pastan et al. | |
| 5,589,384 A | 12/1996 | Lipscombe et al. | |
| 5,602,095 A | 2/1997 | Pastan et al. | |
| 5,668,255 A | 9/1997 | Murphy | |
| 5,696,237 A | 12/1997 | Fitzgerald et al. | |
| 5,817,633 A | 10/1998 | Heerze et al. | |
| 5,863,745 A | 1/1999 | Fitzgerald et al. | |
| 6,022,950 A | 2/2000 | Murphy | |
| 6,051,405 A | 4/2000 | Fitzgerald et al. | |
| 6,086,900 A | 7/2000 | Draper | |
| 6,086,918 A | 7/2000 | Stern et al. | |
| 6,251,392 B1 | 6/2001 | Hein et al. | |
| 6,440,419 B1 | 8/2002 | Hein et al. | |
| 6,565,856 B1 * | 5/2003 | Skeiky ................. | C07K 14/295 424/263.1 |
| 6,613,332 B1 | 9/2003 | Michael et al. | |
| 6,673,574 B2 | 1/2004 | Stern et al. | |
| 6,838,553 B1 | 1/2005 | Hwang et al. | |
| 7,193,055 B2 | 3/2007 | Daugherty et al. | |
| 7,314,625 B2 | 1/2008 | Fitzgerald | |
| 7,314,632 B1 | 1/2008 | Fitzgerald | |
| 7,335,361 B2 | 2/2008 | Liao et al. | |
| 7,378,100 B2 | 5/2008 | Chang et al. | |
| 7,465,455 B2 | 12/2008 | Chang et al. | |
| 7,595,054 B2 | 9/2009 | Liao et al. | |
| 7,611,714 B2 | 11/2009 | Mrsny | |
| 7,618,635 B2 | 11/2009 | Chang et al. | |
| 7,666,991 B2 | 2/2010 | Mrsny | |
| 7,713,737 B2 | 5/2010 | Mrsny | |
| 7,727,538 B2 | 6/2010 | Quinn et al. | |

(Continued)

FOREIGN PATENT DOCUMENTS

| | | |
|---|---|---|
| CN | 101522214 A | 9/2009 |
| CN | 103249401 A | 8/2013 |

(Continued)

OTHER PUBLICATIONS

Skolnick et al. Trends in Biotechnology 18: 34-39, 2000.*

(Continued)

*Primary Examiner* — Sarvamangala Devi

(74) *Attorney, Agent, or Firm* — Wilson Sonsini Goodrich & Rosati

(57) ABSTRACT

The present disclosure provides delivery constructs comprising a carrier coupled to a heterologous payload, wherein coupling of the carrier to the payload can result in transportation of the payload (e.g., a therapeutic payload) into and/or across intact polarized epithelial cells (e.g., epithelial cells of the gut of a mammal). The delivery construct can be part of a pharmaceutical composition that can be orally administered to a subject to provide for improved, effective therapies for treatment of, e.g., inflammatory diseases or autoimmune diseases.

16 Claims, 37 Drawing Sheets

Specification includes a Sequence Listing.

(56) References Cited

U.S. PATENT DOCUMENTS

| | | |
|---|---|---|
| 7,824,695 B1 | 11/2010 | Fitzgerald et al. |
| 7,964,200 B2 | 6/2011 | Mrsny et al. |
| 8,092,806 B2 | 1/2012 | Wallach et al. |
| 8,092,809 B2 | 1/2012 | Fitzgerald |
| 8,206,950 B2 | 6/2012 | Liao et al. |
| 8,309,102 B2 | 11/2012 | Mrsny et al. |
| 8,372,407 B2 | 2/2013 | Liao et al. |
| 8,790,897 B2 | 7/2014 | Quinn et al. |
| 8,993,295 B2 | 3/2015 | Seed et al. |
| 9,090,691 B2 | 7/2015 | Mrsny et al. |
| 9,259,456 B2 | 2/2016 | Kidron |
| 9,481,714 B2 | 11/2016 | Wu et al. |
| 9,657,063 B2 | 5/2017 | Kuo et al. |
| 10,010,602 B2 | 7/2018 | Chien et al. |
| 10,130,688 B2 | 11/2018 | Mrsny et al. |
| 10,143,726 B2 | 12/2018 | Oft |
| 10,400,013 B2 | 9/2019 | Liao et al. |
| 10,617,741 B2 | 4/2020 | Mrsny et al. |
| 10,617,767 B2 | 4/2020 | Mrsny et al. |
| 10,624,955 B2 | 4/2020 | Mrsny et al. |
| 10,624,956 B2 | 4/2020 | Mrsny et al. |
| 10,624,957 B2 | 4/2020 | Mrsny et al. |
| 10,786,555 B2 | 9/2020 | Mrsny et al. |
| 10,786,556 B2 | 9/2020 | Mrsny et al. |
| 10,799,565 B2 | 10/2020 | Mrsny et al. |
| 11,027,020 B2 | 6/2021 | Mrsny et al. |
| 2003/0054012 A1 | 3/2003 | Fitzgerald et al. |
| 2003/0186386 A1 | 10/2003 | Hansen et al. |
| 2004/0071736 A1 | 4/2004 | Quinn et al. |
| 2005/0079171 A1 | 4/2005 | Fitzgerald et al. |
| 2005/0281885 A1 | 12/2005 | Egilmez et al. |
| 2007/0003578 A1 | 1/2007 | Fitzgerald |
| 2007/0148131 A1 | 6/2007 | Mrsny |
| 2008/0085277 A1* | 4/2008 | Cho ............ A61P 35/00 424/136.1 |
| 2008/0317761 A1 | 12/2008 | Cines et al. |
| 2009/0081235 A1 | 3/2009 | Fitzgerald et al. |
| 2009/0092660 A1 | 4/2009 | Mrsny |
| 2009/0142341 A1 | 6/2009 | Pastan et al. |
| 2009/0148401 A1 | 6/2009 | Mrsny |
| 2009/0155297 A1 | 6/2009 | Mrsny |
| 2009/0285771 A1 | 11/2009 | Mrsny |
| 2009/0285848 A1 | 11/2009 | Mrsny |
| 2009/0304684 A1 | 12/2009 | Mrsny |
| 2009/0305978 A1 | 12/2009 | Zane |
| 2010/0151005 A1 | 6/2010 | Muro-Galindo et al. |
| 2010/0196277 A1 | 8/2010 | Desimone et al. |
| 2011/0250199 A1 | 10/2011 | Fitzgerald et al. |
| 2012/0258104 A1 | 10/2012 | Echeverri et al. |
| 2012/0276190 A1 | 11/2012 | Fitzgerald |
| 2013/0172229 A1 | 7/2013 | Mrsny et al. |
| 2014/0065172 A1 | 3/2014 | Echeverri et al. |
| 2015/0265718 A1 | 9/2015 | Mrsny et al. |
| 2015/0265719 A1 | 9/2015 | Mrsny et al. |
| 2016/0068583 A1 | 3/2016 | Van et al. |
| 2016/0222362 A1 | 8/2016 | Zhang et al. |
| 2016/0263020 A1 | 9/2016 | Yan et al. |
| 2017/0281736 A1 | 10/2017 | Mrsny et al. |
| 2018/0028614 A1 | 2/2018 | Huang et al. |
| 2018/0353610 A1 | 12/2018 | Mrsny et al. |
| 2019/0015441 A1 | 1/2019 | Shachar et al. |
| 2019/0105375 A1 | 4/2019 | Mrsny et al. |
| 2019/0117744 A1 | 4/2019 | Mrsny et al. |
| 2019/0177388 A1 | 6/2019 | Scheer et al. |
| 2019/0257832 A1 | 8/2019 | Ulsemer et al. |
| 2020/0030417 A1 | 1/2020 | Mrsny et al. |
| 2020/0140511 A1 | 5/2020 | Porat et al. |
| 2020/0354411 A1 | 11/2020 | Bard et al. |
| 2021/0100887 A1 | 4/2021 | Chen et al. |
| 2021/0154304 A1 | 5/2021 | Maclean et al. |

FOREIGN PATENT DOCUMENTS

| | | |
|---|---|---|
| EP | 0532090 A2 | 3/1993 |
| EP | 1522585 A1 | 4/2005 |
| EP | 1000163 B1 | 10/2005 |
| EP | 1000162 B1 | 9/2006 |
| EP | 1749833 A1 | 2/2007 |
| EP | 1379550 B1 | 3/2009 |
| EP | 1242122 B1 | 9/2009 |
| EP | 1757615 B1 | 8/2011 |
| EP | 1882478 B1 | 3/2012 |
| EP | 1871880 B1 | 8/2012 |
| EP | 2065392 B1 | 8/2012 |
| EP | 2237794 B1 | 4/2013 |
| EP | 3554346 A1 | 10/2019 |
| EP | 3554541 A1 | 10/2019 |
| EP | 3302543 B1 | 4/2020 |
| JP | 2008515808 A | 5/2008 |
| KR | 20140014068 A | 2/2014 |
| WO | WO-2006044205 A2 | 4/2006 |
| WO | WO-2007109110 A2 | 9/2007 |
| WO | WO-2008021234 A2 | 2/2008 |
| WO | WO-2009014650 A2 | 1/2009 |
| WO | WO-2009115531 A2 | 9/2009 |
| WO | WO-2009149281 A1 | 12/2009 |
| WO | WO-2010046783 A2 | 4/2010 |
| WO | WO-2012036746 A1 | 3/2012 |
| WO | WO-2012101235 A1 | 8/2012 |
| WO | WO-2012110596 A1 | 8/2012 |
| WO | WO-2013003824 A1 | 1/2013 |
| WO | WO-2013130913 A1 | 9/2013 |
| WO | WO-2015171965 A2 | 11/2015 |
| WO | WO-2015171965 A3 | 3/2016 |
| WO | WO-2016073915 A1 | 5/2016 |
| WO | WO-2018106895 A1 | 6/2018 |
| WO | WO-2018175340 A1 | 9/2018 |
| WO | WO-2018183931 A1 | 10/2018 |
| WO | WO-2019036382 A1 | 2/2019 |
| WO | WO-2019089603 A1 | 5/2019 |
| WO | WO-2019133647 A1 | 7/2019 |
| WO | WO-2019173787 A1 | 9/2019 |
| WO | WO-2020023389 A1 | 1/2020 |
| WO | WO-2020096695 A1 | 5/2020 |

OTHER PUBLICATIONS

Rudinger J. In: Peptide Hormones. (Ed) JA Parsons, University Park Press, pp. 1-7, 1976.*
Lazar et al. Mol. Cellular Biol. 8: 1247-1252, 1988.*
BR11-2013-006088-3 Office Action dated Apr. 13, 2021 (w/ English translation).
Capra et al. Predicting functionally important residues from sequence conservation. Bioinformatics 23(15):1875-1882 (2007). Advance Access publication May 22, 2007.
EP19717013.7 Office Action dated May 20, 2021.
Gray et al. Cloning, nucleotide sequence, and expression in *Escherichia coli* of the exotoxin A structural gene of Pseudomonas aeruginosa. Proc Natl Acad Sci, vol. 81, pp. 2645-2649 (May 1984).
PCT/US2019/050708 International Preliminary Report on Patentability dated May 11, 2021.
PH1-2016-502447 Office Action dated Mar. 12, 2021.
Co-pending U.S. Appl. No. 17/129,376, inventors Hunter; Thomas Carl et al., filed Dec. 21, 2020.
Challa et al. Bacterial Toxin Fusion Proteins Elicit Mucosal Immunity against a Foot-and-Mouth Disease Virus Antigen When Administered Intranasally to Guinea Pigs. Adv Virol, vol. 2011, Article ID 713769 (2011). 11 pages.

Challa et al. MARTs and MARylation in the Cytosol: Biological Functions, Mechanisms of Action, and Therapeutic Potential. Cells 10:313 (Feb. 3, 2021). 21 pages.

Challa et al. Non-toxic Pseudomonas aeruginosa exotoxin A expressing the FMDV VP1 G-H loop for mucosal vaccination of swine against foot and mouth disease virus. Vaccine 25 (2007) 3328-3337. Available online Jan. 12, 2007.

Hsu, et al. Vaccination against Gonadotropin-releasing Hormone (GnRH). Cancer Res. Jul. 15, 2000; 60:3701-3705.

(56) References Cited

OTHER PUBLICATIONS

Kim et al. Induction of anti-inflammatory immune response by an adenovirus vector encoding 11 tandem repeats of Aβ1-6: Toward safer and effective vaccines against Alzheimer's disease. Biochemical and Biophysical Research Communications 336:84-92 (2005). Available online Aug. 19, 2005.

Amre et al. Interleukin 10 (IL-10) gene variants and susceptibility for paediatric onset Crohn's disease. Aliment Pharmacol Ther 29(9):1025-31 (May 1, 2009). Epub Feb. 7, 2009.

Apostolaki et al. Nasal Delivery of Antigen with the B Subunit of *Escherichia coli* Heat-Labile Enterotoxin Augments Antigen-Specific T-Cell Clonal Expansion and Differentiation. Infection and Immunity 72(7):4072-4080 (Jul. 2004). DOI: 10.1128/IAI.72.7.4072-4080.2004.

Buruiana et al. Recombinant human interleukin 10 for induction of remission in Crohn's disease. Cochrane Database Syst Rev (11):CD005109 (Nov. 10, 2010). 20 pages.

Ji et al. The B subunit of *Escherichia coli* heat-labile toxin alters the development and antigen-presenting capacity of dendritic cells. J Cell Mol Med 19(8):2019-2031 (2015). doi: 10.1111/jcmm.12599.

Mrsny. A Carrier-Mediated Approach for the Oral Delivery of Protein Therapeutics. (Presentation.) (Aug. 28, 2019.) 24 pages.

Mrsny. Biotech Start-up—A Practical Guide. Bath, United Kingdom (Presentation.) (Nov. 19, 2018.) 18 pages.

Mrsny. Breaking Through the Biological Barriers that Limit Protein Drug Delivery. Bangor University, United Kingdom (Presentation.) (Aug. 6, 2015.) 26 pages.

Mrsny. Breaking Through the Biological Barriers that Limit Protein Drug Delivery. (Presentation.) Controlled Release Society, Florence, Italy (Nov. 8, 2014.) 43 pages.

Mrsny. Breaking Through the Biological Barriers that Limit Protein Drug Delivery. (Presentation.) Tours, France (Jul. 2, 2015.) 25 pages.

Mrsny. Employing endogenous pathways for the oral delivery of biopharmaceuticals. (Presentation.) Reading, United Kingdom (Jul. 18, 2018.) 35 pages.

Mrsny. Harnessing Mucosal Immunology for Health. Bath, United Kingdom (Presentation.) (Sep. 25, 2018.) 29 pages.

Mrsny. Harnessing Mucosal Immunology for Health. Ma'alot-Tarshiha, Israel (Presentation.) (Oct. 7, 2018.) 28 pages.

Mrsny. It Starts With Asking Big Questions. Valencia, Spain (Presentation.) (Jul. 21, 2019.) 20 pages.

Mrsny. Molecular mechanisms of transcytosis pathways: Drug delivery thru epithelial and endothelial barriers. (Presentation.) (Dec. 3, 2010). 42 pages.

Mrsny. Molecular mechanisms of transcytosis pathways: Drug delivery thru epithelial and endothelial barriers. (Presentation.) Emory University, Atlanta, GA, United States. (Sep. 24, 2010). 51 pages.

Mrsny. Molecular mechanisms of transcytosis pathways: Drug delivery thru epithelial and endothelial barriers. (Presentation.) Nanomedicine and Drug Delivery Symposium (NanoDDS), University of Nebraska Omaha, Omaha, NE, United States. (Oct. 3, 2010.) 42 pages.

Mrsny. My Secondment(Gap Years?) at AMT. University of Bath, United Kingdom (Presentation.) (Oct. 6, 2017.) 20 pages.

Mrsny. Overcoming Barriers to Oral Protein Delivery. Boston, MA, United States (Presentation.) (Jul. 23, 2018.) 35 pages.

Mrsny. Overcoming Biological Barriers that Limit Peptide and Protein Drug Delivery. Berlin, Germany (Presentation.) (May 23, 2016.) 26 pages.

Mrsny. Overcoming Biological Barriers that Limit Peptide and Protein Drug Delivery. Denver, CO, United States (Presentation.) (Nov. 17, 2016.) 15 pages.

Mrsny. Overcoming Biological Barriers that Limit Peptide and Protein Drug Delivery. (Presentation.) (Jun. 14, 2016.) 36 pages.

Mrsny. Overcoming Biological Barriers that Limit Peptide and Protein Drug Delivery. University of California San Francisco, CA, United States (Presentation.) (Mar. 24, 2016.) 36 pages.

Mrsny. Paracellular and Transcellular Strategies to Enhance Oral Protein Delivery. (Presentation.) San Francisco, CA, United States (Mar. 15, 2013.) 41 pages.

Mrsny. Paracellular and Transcellular Strategies to Enhance Oral Protein Delivery. (Presentation.) Seoul, South Korea (Mar. 15, 2012.) 54 pages.

Mrsny. Paracellular and Transcellular Strategies to Enhance Oral Protein Delivery. (Presentation.) University of California, Santa Barbara, CA, United States. (Feb. 26, 2013.) 54 pages.

Mrsny. Prospects for Oral Delivery of Peptide and Protein Therapeutics. San Francisco, CA, United States (Presentation.) (May 21, 2018.) 29 pages.

Mrsny. Prospects for Oral Delivery of Peptide and Protein Therapeutics. University of Nottingham, United Kingdom (Presentation.) (Jun. 20, 2018.) 62 pages.

Mrsny. Strategies to Enhance the Oral Delivery of Therapeutic Proteins and Peptides. (Presentation.) Berlin, Germany. (Sep. 28, 2011.) 42 pages.

Mrsny. Strategies to Enhance the Oral Delivery of Therapeutic Proteins and Peptides. (Presentation.) Dunedin, New Zealand (Feb. 15, 2012). 42 pages.

Mrsny. Strategies to Enhance the Oral Delivery of Therapeutic Proteins and Peptides. (Presentation.) Nottingham, United Kingdom. (Sep. 2, 2011.) 42 pages.

Mrsny. Strategies to Enhance the Oral Delivery of Therapeutic Proteins and Peptides. (Presentation.) San Francisco, CA, United States. (Jun. 20, 2011.) 42 pages.

Mrsny. Strategies to Enhance the Oral Delivery of Therapeutic Proteins and Peptides. (Presentation.) The University of Sheffield, Sheffield, United Kingdom. (Jan. 16, 2012.) 42 pages.

Mrsny. TJ Regulation using Cell-Penetrating Peptides. (Presentation.) University of Copenhagen, Denmark (May 12, 2015.) 62 pages.

Mrsny. Understanding & Developing the Science Behind Oral Protein and Peptide Delivery. (Presentation.) Nottingham, United Kingdom (Jan. 22, 2014.) 48 pages.

Mrsny. Understanding & Developing the Science Behind Oral Protein Delivery: An Academic Case Study. (Presentation.) Berlin, Germany (Feb. 20, 2013.) 39 pages.

Mrsny. Understanding & Developing the Science Behind Oral Protein Delivery. (Presentation.) University of North Carolina at Chapel Hill, Chapel Hill, North Carolina, United States. (May 28, 2014.) 37 pages.

Mrsny. Understanding & Developing the Science Behind Oral Protein Delivery. (Presentation.) University of Westminster, London, United Kingdom. (Mar. 15, 2013). 40 pages.

Mrsny. Understanding & Developing the Science Behind Oral Protein Delivery. (Presentation.) Academy of Pharmaceutical Sciences, Edinburgh, United Kingdom.(Sep. 3, 2013). 40 pages.

Mrsny. Understanding & Developing the Science Behind Oral Protein Delivery. (Presentation.) University College Dublin, Dublin, Ireland (May 22, 2013). 44 pages.

Mrsny. Understanding & Developing the Science Behind Oral Protein Delivery. (Presentation.) University of East Anglia, Norwich, United Kingdom (Jun. 27, 2013). 43 pages.

Mrsny. Understanding Exotoxin Transcytosis for the Application of Oral Protein Delivery. Dresden, Germany (Presentation.) (Nov. 12, 2015.) 26 pages.

Porat. Accelerating Development of a Novel Chimera Protein through the Identification of a Two Column Purification Process Using NH2-750F and CaPure Resins. San Francisco, CA, United States. (Presentation.) (Nov. 7, 2018.) 30 pages.

Sarnovsky, et al. Initial characterization of an immunotoxin constructed from domains II and III of cholera exotoxin. Cancer Immunol. Immunother., 59.5 2010 (published online Nov. 2009):737-746.

IN201617041645 Office Action dated Dec. 9, 2020 (w/ English translation).

Bublin et al. Use of a genetic cholera toxin B subunit/allergen fusion molecule as mucosal delivery system with immunosuppressive activity against Th2 immune responses. Vaccine 25(50):8395-8404 (Dec. 5, 2007). DOI: https://doi.org/10.1016/j.vaccine.2007.10.003. Available online Oct. 22, 2007.

(56) References Cited

OTHER PUBLICATIONS

Co-pending U.S. Appl. No. 16/997,781, inventors Mrsny; Randall J. et al., filed Aug. 19, 2020.
Co-pending U.S. Appl. No. 17/004,686, inventors Mrsny; Randall J. et al., filed Aug. 27, 2020.
Co-pending U.S. Appl. No. 17/015,011, inventor Liu; Keyi, filed Sep. 8, 2020.
IN3153/DELNP/2013 Hearing Notice dispatched Jul. 30, 2020.
Mrsny. Permeation of barriers for GI and pulmonary drug delivery. (Presentation.) Gordon Research Conference, New Hampshire, United States. (Aug. 13, 2012.) 46 pages.
PCT/US2011/001602 International Preliminary Report on Patentability dated Mar. 19, 2013.
PCT/US2015/029795 International Preliminary Report on Patentability dated Nov. 8, 2016.
PCT/US2019/021474 International Preliminary Report on Patentability dated Sep. 8, 2020.
PH1-2016-502447 Office Action dated Jun. 17, 2020.
Shiraishi et al. Enhanced delivery of cell-penetrating peptide-peptide nucleic acid conjugates by endosomal disruption. Nat Protoc. 2006;1(2):633-6. Published online Jun. 29, 2006. doi: 10.1038/nprot.2006.92.
U.S. Appl. No. 16/151,533 Notice of Allowance dated Jul. 16, 2020.
U.S. Appl. No. 16/151,533 Notice of Allowance dated Sep. 18, 2020.
U.S. Appl. No. 16/151,533 Notice of Allowance dated Sep. 8, 2020.
U.S. Appl. No. 16/207,655 Notice of Allowance dated Aug. 28, 2020.
U.S. Appl. No. 16/220,923 Notice of Allowance dated Aug. 27, 2020.
Wahlich et al. Nanomedicines for the Delivery of Biologies. Pharmaceutics. May 2019; 11(5): 210. Published online May 3, 2019. doi: 10.3390/pharmaceutics11050210. 14 pages.
Wingfield. N-Terminal Methionine Processing. Curr Protoc Protein Sci 88:6.14.1-6.14.3 (2017). First published Apr. 3, 2017. doi:10.1002/cpps.29.
Yahiro et al. Cholix toxin, an eukaryotic elongation factor 2 ADP-ribosyltransferase, interacts with Prohibitins and induces apoptosis with mitochondrial dysfunction in human hepatocytes. Cell Microbiol. Aug. 2019;21(8):e13033.doi: 10.1111/cmi.13033. Epub May 14, 2019.
GenBank Accession No. WP_114728533. Version No. WP_114728533.1. cholix toxin [Vibrio cholerae]. Record created Aug. 2, 2018. 2 pages. Retrieved Mar. 19, 2021 at URL: https://www.ncbi.nlm.nih.gov/protein/WP_114728533.1.
Allured et al., "Structure of exotoxin A of Pseudomonas aeruginosa at 3.0-Angstrom resolution," PNAS USA 83:1320-1324, 1986.
Aman et al. A mutant cholera toxin B subunit that binds GM1-ganglioside but lacks immunomodulatory or toxic activity. PNAS 98(15):8536-8541 (Jul. 17, 2001).
Anselmo et al. Non-invasive delivery strategies for biologies. Nature Reviews Drug Discovery 18:19-40 (Jan. 2019). Published online Nov. 30, 2018.
Arango Duque et al. Macrophage cytokines: involvement in immunity and infectious diseases. Frontiers in Immunology, vol. 5, Article 491, 12 pages (Oct. 7, 2014).
Arbit et al. Oral Insulin Delivery in a Physiologic Context: Review. J Diabetes Sci Technol 11(4):825-832 (Jul. 2017) Epub Feb. 2, 2017.
Arhewoh et al. An overview of site-specific delivery of orally administered proteins/peptides and modelling considerations. JMBR: A Peer-review Journal of Biomedical Sciences 3(1):7-20 (Jun. 2004).
Asadullah et al. Interleukin-10 Therapy—Review of a New Approach. Pharmacological Reviews 55(2):241-269 (2003). DOI: https://doi.org/10.1124/pr.55.2.4.
AU2011302645 Office Action dated Oct. 30, 2014.
AU2015255834 Office Action dated Jan. 15, 2020.
Awasthi et al. Development of a PCR-restriction fragment length polymorphism assay for detection and subtyping of cholix toxin variant genes of Vibrio cholerae. Journal of Medical Microbiology 63(5):667-673 (May 1, 2014). DOI: 10.1099/jmm.0.070797-0.
Awasthi et al. Novel Cholix Toxin Variants, ADP-Ribosylating Toxins in Vibriocholerae Non-O1/Non-O139 Strains, and Their Pathogenicity. Infection and Immunity 81(2):531-541 (Feb. 2013). Published ahead of print Dec. 10, 2012.
Basset et al. Cholera-Like Enterotoxins and Regulatory T cells. Toxins 2:1774-1795 (Jul. 6, 2010). doi: 10.3390/toxins2071774.
Beddoe, et al. Structure, biological functions and applications of the AB5 toxins. Trends in Biochemical Sciences. 35.7 (2010): 411-418.
Bignon et al. *Escherichia coli* Heat-Labile Enterotoxin B Limits T Cells Activation by Promoting Immature Dendritic Cells and Enhancing Regulatory T Cell Function. Frontiers in Immunology, vol. 8, Article 560 (May 15, 2017). 13 pages, doi: 10.3389/fimmu.2017.00560.
Bishop-Lilly et al. Genome Sequencing of 15 Clinical Vibrio Isolates, Including 13 Non-O1/Non-O139 Serogroup Strains. Genome Announc 2(5):e00893-14 (Sep. 11, 2014). doi:10.1128/genomeA.00893-14.
Boirivant et al. Oral Administration of Recombinant Cholera Toxin Subunit B Inhibits IL-12-Mediated Murine Experimental (Trinitrobenzene Sulfonic Acid) Colitis. J Immunol 166:3522-3532 (2001). doi: 10.4049/jimmunol.166.5.3522.
Bone et al. Modulation of B lymphocyte signalling by the B subunit of *Escherichia coli* heat-labile enterotoxin. International Immunology 14(6):647-658 (2002).
Bublin et al. Use of a genetic cholera toxin B subunit/allergen fusion molecule as mucosal delivery system with immunosuppressive activity against Th2 immune responses. Vaccine 25(50):8395-8404 (Dec. 5, 2007). DOI: https://doi.org/10.1016/j.vaccine.2007.10.003.
Buruiana et al. Recombinant human interleukin 10 for induction of remission in Crohn's disease. Cochrane Database Syst Rev (11):CD005109 (Nov. 10, 2010).
Chernoff et al. A randomized, controlled trial of IL-10 in humans. Inhibition of inflammatory cytokine production and immune responses. J Immunol 154:5492-5499 (1995).
Choonara et al. A review of advanced oral drug delivery technologies facilitating the protection and absorption of protein and peptide molecules. Biotechnology Advances 32:1269-1282 (2014). Available online Aug. 3, 2014.
CN201580036678.8 Office Action dated Jan. 22, 2020 (w/ English translation).
CN201580036678.8 Office Action dated Jan. 3, 2019 (w/ English translation).
Co-pending U.S. Appl. No. 16/779,350, filed Jan. 31, 2020.
Crowe et al. Oral delivery of the anti-tumor necrosis factor a domain antibody, V565, results in high intestinal and fecal concentrations with minimal systemic exposure in cynomolgus monkeys. Drug Development and Industrial Pharmacy 45(3):387-394 (2019). Accepted author version posted online Nov. 5, 2018. Published online Nov. 25, 2018.
Dalmas et al. A role for interleukin-22 in the alleviation of metabolic syndrome. Nature Medicine 20(12):1379-1381 (Dec. 2014). Published online Nov. 2, 2014. doi: 10.1038/nm.3748.
Deng, et al. Molecular mechanisms of the cytotoxicity of ADP-ribosylating toxins. Annual Review of Microbiology 62 (2008): 271-288.
Dibiase, et al. Oral delivery of microencapsulated proteins. Pharm Biotechnol. 1997;10:255-88.
Donaldson et al. Mucosal administration of the B subunit of *E. coli* heat-labile enterotoxin promotes the development of Foxp3-expressing regulatory T cells. Mucosal Immunology 4(2):227-238 (Mar. 2011). Published online Oct. 13, 2010. doi: 10.1038/mi.2010.65.
Donaldson et al. The *Escherichia coli* heat-labile enterotoxin B subunit protects from allergic airway disease development by inducing CD4+ regulatory T cells. Mucosal Immunology 6(3):535-546 (May 2013). Published online Oct. 3, 2012. doi: 10.1038/mi.2012.93.
Dudakov et al. Interleukin-22: immunobiology and pathology. Annu Rev Immunol 33:747-785 (Mar. 21, 2015). doi:10.1146/annurev-immunol-032414-112123.

(56) References Cited

OTHER PUBLICATIONS

Dumoutier et al. Cloning and Characterization of IL-10-Related T Cell-Derived Inducible Factor (IL-TIF), a Novel Cytokine Structurally Related to IL-10 and Inducible by IL-9. J Immunol 164:1814-1819 (2000). doi: 10.4049/jimmunol.164.4.1814.
EP11825567.8 Office Action dated Feb. 23, 2017.
EP15788688.8 Office Action dated Apr. 22, 2020.
EP15788688.8 Office Action dated Jun. 17, 2019.
EP15788688.8 Partial Supplementary European Search Report dated Nov. 27, 2017.
EP15788688.8 Extended European Search Report dated Mar. 8, 2018.
European search report and search opinion dated Nov. 24, 2014 for EP Patent Application No. 11825567.8.
Fitzgerald, et al. Pseudomonas exotoxin-mediated selection yields cells with altered expression of low-density lipoprotein receptor-related protein. Journ of Cell Biology, 129.6(1995): 1533-1541.
Fraser et al. Mutant *Escherichia coli* Heat-Labile Toxin B Subunit That Separates Toxoid-Mediated Signaling and Immunomodulatory Action from Trafficking and Delivery Functions. Infection and Immunity 71(3):1527-1537 (Mar. 2003). DOI: 10.1128/IAI.71.3.000-000.2003.
Friedrich et al. Immunomodulation by Interleukin-10 Therapy Decreases the Incidence of Relapse and Prolongs the Relapse-free Interval in Psoriasis. Journal of Investigative Dermatology 118(4):672-677 (2002).
GenBank Accession No. AAW80252. Version No. AAW80252.1 hypothetical exotoxin A [Vibrio cholerae]. Record created Feb. 9, 2005. 2 pages. Retrieved Nov. 11, 2019 at URL: https://www.ncbi.nlm.nih.gov/protein/58615288?report=ipg.
GenBank Accession No. AKB06426. Version No. AKB06426.1. exotoxin A catalytic family protein [Vibrio cholerae]. Record created Apr. 6, 2015. 2 pages. Retrieved Aug. 30, 2019 at URL: https://www.ncbi.nlm.nih.gov/protein/AKB06426.
GenBank Accession No. ALH24940. Version No. ALH24940.1. cholix toxin [Vibrio cholerae]. Record created Oct. 11, 2015. 2 pages. Retrieved Sep. 6, 2019 at URL: https://www.ncbi.nlm.nih.gov/protein/ALH24940.1.
GenBank Accession No. ALI16365. Version No. ALI16365.1. truncated cholix toxin [Vibrio cholerae]. Record created Oct. 12, 2015. 2 pages. Retrieved Sep. 9, 2019 at URL: https://www.ncbi.nlm.nih.gov/protein/ALI16365.1.
GenBank Accession No. ALI16366. Version No. ALI16366.1. truncated cholix toxin [Vibrio cholerae]. Record created Oct. 12, 2015. 2 pages. Retrieved Sep. 9, 2019 at URL: https://www.ncbi.nlm.nih.gov/protein/ALI16366.1.
GenBank Accession No. ALI87044. Version No. ALI87044.1. cholix toxin [Vibrio cholerae]. Record created Oct. 14, 2015. 2 pages. Retrieved Aug. 30, 2019 at URL: https://www.ncbi.nlm.nih.gov/protein/ALI87044.1.
GenBank Accession No. ALJ02941. Version No. ALJ02941.1. cholix toxin [Vibrio cholerae]. Record created Oct. 18, 2015. 2 pages. Retrieved Sep. 6, 2019 at URL: https://www.ncbi.nlm.nih.gov/protein/ALJ02941.1.
GenBank Accession No. AUT32289. Version No. AUT32289.1. cholix toxin [Vibrio cholerae]. Record created Jan. 31, 2018. 2 pages. Retrieved Sep. 6, 2019 at URL: https://www.ncbi.nlm.nih.gov/protein/AUT32289.1.
GenBank Accession No. AUT32291. Version No. AUT32291.1. cholix toxin [Vibrio cholerae]. Record created Jan. 31, 2018. 2 pages. Retrieved Sep. 6, 2019 at URL: https://www.ncbi.nlm.nih.gov/protein/AUT32291.1.
GenBank Accession No. AUT32293. Version No. AUT32293.1. cholix toxin [Vibrio cholerae]. Record created Jan. 31, 2018. 2 pages. Retrieved Sep. 6, 2019 at URL: https://www.ncbi.nlm.nih.gov/protein/AUT32293.1.
GenBank Accession No. AUT32294. Version No. AUT32294.1. cholix toxin [Vibrio cholerae]. Record created Jan. 31, 2018. 2 pages. Retrieved Sep. 6, 2019 at URL: https://www.ncbi.nlm.nih.gov/protein/AUT32294.1.
GenBank Accession No. BAM72568. Version No. BAM72568.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72568.1.
GenBank Accession No. BAM72569. Version No. BAM72569.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72569.1.
GenBank Accession No. BAM72570. Version No. BAM72570.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72570.1.
GenBank Accession No. BAM72571. Version No. BAM72571.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72571.1.
GenBank Accession No. BAM72573. Version No. BAM72573.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72573.1.
GenBank Accession No. BAM72574. Version No. BAM72574.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72574.1.
GenBank Accession No. BAM72575. Version No. BAM72575.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72575.1.
GenBank Accession No. BAM72576. Version No. BAM72576.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72576.1.
GenBank Accession No. BAM72582. Version No. BAM72582.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72582.1.
GenBank Accession No. BAM72585. Version No. BAM72585.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72585.1.
GenBank Accession No. BAM72587. Version No. BAM72587.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72587.1.
GenBank Accession No. BAM72590. Version No. BAM72590.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72590.1.
GenBank Accession No. BAM72593. Version No. BAM72593.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72593.1.
GenBank Accession No. BAM72594. Version No. BAM72594.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72594.1.
GenBank Accession No. BAM72595. Version No. BAM72595.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72595.1.
GenBank Accession No. BAM72596. Version No. BAM72596.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72596.1.
GenBank Accession No. BAM72610. Version No. BAM72610.1. cholix toxin, partial [Vibrio cholerae]. Record created Dec. 14, 2012. 2 pages. Retrieved Sep. 9, 2019 at URL: https://www.ncbi.nlm.nih.gov/protein/BAM72610.1.
GenBank Accession No. BAM72611. Version No. BAM72611.1. cholix toxin, partial [Vibrio cholerae]. Record created Dec. 14, 2012. 2 pages. Retrieved Sep. 6, 2019 at URL: https://www.ncbi.nlm.nih.gov/protein/BAM72611.1.

(56) References Cited

OTHER PUBLICATIONS

GenBank Accession No. EFH75651. Version No. EFH75651.1. conserved hypothetical protein [Vibrio cholerae RC385]. Record created Jun. 4, 2010. 2 pages. Retrieved Sep. 6, 2019 at URL: https://www.ncbi.nlm.nih.gov/protein/EFH75651.1.
GenBank Accession No. KFD89501. Version No. KFD89501.1. exotoxin A binding family protein [Vibrio cholerae]. Record created Jul. 31, 2014. pages. Retrieved Sep. 6, 2019 at URL: https://www.ncbi.nlm.nih.gov/protein/KFD89501.1.
GenBank Accession No. KFD96741. Version No. KFD96741.1. exotoxin A binding family protein [Vibrio cholerae]. Record created Jul. 31, 2014. 2 pages. Retrieved Sep. 9, 2019 at URL: https://www.ncbi.nlm.nih.gov/protein/KFD96741.1.
GenBank Accession No. KFE28160. Version No. KFE28160.1. exotoxin A binding family protein [Vibrio cholerae]. Record created Jul. 31, 2014. 2 pages. Retrieved Sep. 6, 2019 at URL: https://www.ncbi.nlm.nih.gov/protein/KFE28160.1.
GenBank Accession No. KNH55243. Version No. KNH55243.1. hypothetical protein A59_2898 [Vibrio cholerae 623-39]. Record created Aug. 5, 2015. 2 pages. Retrieved Sep. 6, 2019 at URL: https://www.ncbi.nlm.nih.gov/protein/KNH55243.1.
GenBank Accession No. P01241. Somatotropin. Record created Jul. 21, 1986. 12 pages. Retrieved Aug. 29, 2019 at URL: https://www.ncbi.nlm.nih.gov/protein/P01241.
GenBank Accession No. Q5EK40. Version No. Q5EK40.1. Cholix toxin. Record created Feb. 9, 2005. 9 pages. Retrieved Aug. 30, 2019 at URL: https://www.ncbi.nlm.nih.gov/protein/Q5EK40.1.
GenBank Accession No. SYZ81493. Version No. SYZ81493.1. Cholix toxin precursor [Vibrio cholerae]. Record created Sep. 6, 2018. 1 page. Retrieved Sep. 9, 2019 at URL: https://www.ncbi.nlm.nih.gov/protein/SYZ81493.1.
GenBank Accession No. WP_000941100. Version No. WP_000941100.1. Multispecies: cholix toxin [Vibrio]. Record created Feb. 5, 2013. 1 page. Retrieved Sep. 9, 2019 at URL: https://www.ncbi.nlm.nih.gov/protein/WP_000941100.1.
GenBank Accession No. WP_002044040. Version No. WP_002044040.1. cholix toxin [Vibrio cholerae]. Record created May 4, 2013. 1 page. Retrieved Sep. 9, 2019 at URL: https://www.ncbi.nlm.nih.gov/protein/WP_002044040.1.
GenBank Accession No. WP_032467916. Version No. WP_032467916.1. cholix toxin [Vibrio cholerae]. Record created Oct. 4, 2014. 1 page. Retrieved Sep. 9, 2019 at URL: https://www.ncbi.nlm.nih.gov/protein/WP_032467916.1.
GenBank Accession No. WP_032482668. Version No. WP_032482668.1. cholix toxin [Vibrio cholerae]. Record created Oct. 4, 2014. 1 page. Retrieved Sep. 9, 2019 at URL: https://www.ncbi.nlm.nih.gov/protein/WP_032482668.1.
GenBank Accession No. WP_033932701. Version No. WP_033932701.1. cholix toxin [Vibrio cholerae]. Record created Dec. 5, 2014. 1 page. Retrieved Sep. 9, 2019 at URL: https://www.ncbi.nlm.nih.gov/protein/WP_033932701.1.
GenBank Accession No. WP_042988437. Version No. WP_042988437.1. cholix toxin [Vibrio cholerae]. Record created Feb. 17, 2015. 1 page. Retrieved Sep. 9, 2019 at URL: https://www.ncbi.nlm.nih.gov/protein/WP_042988437.1.
GenBank Accession No. WP_057552180. Version No. WP_057552180.1. cholix toxin [Vibrio cholerae]. Record created Nov. 10, 2015. 1 page. Retrieved Sep. 9, 2019 at URL: https://www.ncbi.nlm.nih.gov/protein/WP_057552180.1.
GenBank Accession No. WP_057557199. Version No. WP_057557199.1. cholix toxin [Vibrio cholerae]. Record created Nov. 10, 2015. 1 page. Retrieved Sep. 9, 2019 at URL: https://www.ncbi.nlm.nih.gov/protein/WP_057557199.1.
GenBank Accession No. WP_069648100. Version No. WP_069648100.1. cholix toxin [Vibrio cholerae]. Record created Sep. 20, 2016. 1 page. Retrieved Sep. 9, 2019 at URL: https://www.ncbi.nlm.nih.gov/protein/WP_069648100.1.
GenBank Accession No. WP_071178365. Version No. WP_071178365.1. cholix toxin [Vibrio cholerae]. Record created Nov. 2, 2016. 1 page. Retrieved Sep. 9, 2019 at URL: https://www.ncbi.nlm.nih.gov/protein/WP_071178365.1.
GenBank Accession No. WP_071186455. Version No. WP_071186455.1. cholix toxin [Vibrio cholerae]. Record created Nov. 2, 2016. 1 page. Retrieved Sep. 9, 2019 at URL: https://www.ncbi.nlm.nih.gov/protein/WP_071186455.1.
GenBank Accession No. WP_076008260. Version No. WP_076008260.1. cholix toxin [Vibrio cholerae]. Record created Jan. 19, 2017. 1 page. Retrieved Sep. 9, 2019 at URL: https://www.ncbi.nlm.nih.gov/protein/WP_076008260.1.
GenBank Accession No. WP_076025263. Version No. WP_076025263.1. cholix toxin [Vibrio cholerae]. Record created Jan. 19, 2017. 1 page. Retrieved Sep. 9, 2019 at URL: https://www.ncbi.nlm.nih.gov/protein/WP_076025263.1.
GenBank Accession No. WP_084980904. Version No. WP_084980904.1. cholix toxin [Vibrio cholerae]. Record created Apr. 21, 2017. 1 page. Retrieved Sep. 9, 2019 at URL: https://www.ncbi.nlm.nih.gov/protein/WP_084980904.1.
GenBank Accession No. WP_088131881. Version No. WP_088131881.1. cholix toxin [Vibrio cholerae]. Record created Jun. 19, 2017. 1 page. Retrieved Sep. 6, 2019 at URL: https://www.ncbi.nlm.nih.gov/protein/WP_088131881.1.
GenBank Accession No. WP_095461883. Version No. WP_095461883.1. cholix toxin [Vibrio cholerae]. Record created Sep. 2, 2017. 1 page. Retrieved Sep. 9, 2019 at URL: https://www.ncbi.nlm.nih.gov/protein/WP_095461883.1.
GenBank Accession No. WP_095463544. Version No. WP_095463544.1. cholix toxin [Vibrio cholerae]. Record created Sep. 2, 2017. 1 page. Retrieved Sep. 9, 2019 at URL: https://www.ncbi.nlm.nih.gov/protein/WP_095463544.1.
GenBank Accession No. WP_095466115. Version No. WP_095466115.1. cholix toxin [Vibrio cholerae]. Record created Sep. 2, 2017. 1 page. Retrieved Sep. 6, 2019 at URL: https://www.ncbi.nlm.nih.gov/protein/WP_095466115.1.
GenBank Accession No. WP_095473667. Version No. WP_095473667.1. cholix toxin [Vibrio cholerae]. Record created Sep. 2, 2017. 1 page. Retrieved Sep. 9, 2019 at URL: https://www.ncbi.nlm.nih.gov/protein/WP_095473667.1.
GenBank Accession No. WP_095477173. Version No. WP_095477173.1. cholix toxin [Vibrio cholerae]. Record created Sep. 2, 2017. 1 page. Retrieved Sep. 9, 2019 at URL: https://www.ncbi.nlm.nih.gov/protein/WP_095477173.1.
GenBank Accession No. WP_095490358. Version No. WP_095490358.1. cholix toxin [Vibrio cholerae]. Record created Sep. 2, 2017. 1 page. Retrieved Sep. 9, 2019 at URL: https://www.ncbi.nlm.nih.gov/protein/WP_095490358.1.
GenBank Accession No. WP_113605545. Version No. WP_113605545.1. cholix toxin [*Vibrio* sp. 2017V-1105]. Record created Jul. 15, 2018. 1 page. Retrieved Sep. 9, 2019 at URL: https://www.ncbi.nlm.nih.gov/protein/WP_113605545.1.
GenBank Accession No. WP_113620122. Version No. WP_113620122.1. cholix toxin [*Vibrio* sp. 2014V-1107]. Record created Jul. 15, 2018. 1 page. Retrieved Sep. 9, 2019 at URL: https://www.ncbi.nlm.nih.gov/protein/WP_113620122.1.
GenBank Accession No. WP_113628761. Version No. WP_113628761.1. cholix toxin [Vibrio cholerae]. Record created Jul. 15, 2018. 1 page. Retrieved Sep. 6, 2019 at URL: https://www.ncbi.nlm.nih.gov/protein/WP_113628761.1.
GenBank Accession No. WP_114707943. Version No. WP_114707943.1. cholix toxin [Vibrio cholerae]. Record created Aug. 2, 2018. 1 page. Retrieved Sep. 9, 2019 at URL: https://www.ncbi.nlm.nih.gov/protein/WP_114707943.1.
GenBank Accession No. WP_114708586. Version No. WP_114708586.1. cholix toxin [Vibrio cholerae]. Record created Aug. 2, 2018. 1 page. Retrieved Sep. 6, 2019 at URL: https://www.ncbi.nlm.nih.gov/protein/WP_114708586.1.
GenBank Accession No. WP_114711324. Version No. WP_114711324.1. cholix toxin [Vibrio cholerae]. Record created Aug. 2, 2018. 1 page. Retrieved Sep. 9, 2019 at URL: https://www.ncbi.nlm.nih.gov/protein/WP_114711324.1.

(56) References Cited

OTHER PUBLICATIONS

GenBank Accession No. WP_114718037. Version No. WP_114718037.1. cholix toxin [Vibrio cholerae]. Record created Aug. 2, 2018. 1 page. Retrieved Sep. 6, 2019 at URL: https://www.ncbi.nlm.nih.gov/protein/WP_114718037.1.

GenBank Accession No. WP_114728533. Version No. WP_114728533.1. cholix toxin [Vibrio cholerae]. Record created Aug. 2, 2018. 2 pages. Retrieved Sep. 6, 2019 at URL: https://www.ncbi.nlm.nih.gov/protein/WP_114728533.1.

GenBank Accession No. WP_114735885. Version No. WP_114735885.1. cholix toxin [Vibrio cholerae]. Record created Aug. 2, 2018. 1 page. Retrieved Sep. 6, 2019 at URL: https://www.ncbi.nlm.nih.gov/protein/WP_114735885.1.

GenBank Accession No. WP_114741531. Version No. WP_114741531.1. cholix toxin [Vibrio cholerae]. Record created Aug. 2, 2018. 1 page. Retrieved Sep. 6, 2019 at URL: https://www.ncbi.nlm.nih.gov/protein/WP_114741531.1.

GenBank Accession No. WP_114743333. Version No. WP_114743333.1. cholix toxin [Vibrio cholerae]. Record created Aug. 2, 2018. 1 page. Retrieved Sep. 9, 2019 at URL: https://www.ncbi.nlm.nih.gov/protein/WP_114743333.1.

GenBank Accession No. WP_114774300. Version No. WP_114774300.1. cholix toxin [Vibrio cholerae]. Record created Aug. 2, 2018. 1 page. Retrieved Sep. 6, 2019 at URL: https://www.ncbi.nlm.nih.gov/protein/WP_114774300.1.

GenBank Accession No. WP_114776277. Version No. WP_114776277.1. cholix toxin [Vibrio cholerae]. Record created Aug. 2, 2018. 1 page. Retrieved Sep. 6, 2019 at URL: https://www.ncbi.nlm.nih.gov/protein/WP_114776277.1.

GenBank Accession No. WP_114788528. Version No. WP_114788528.1. cholix toxin, partial [Vibrio cholerae]. Record created Aug. 2, 2018. 1 page. Retrieved Sep. 9, 2019 at URL: https://www.ncbi.nlm.nih.gov/protein/WP_114788528.1.

GenBank Accession No. WP_114794357. Version No. WP_114794357.1. cholix toxin [Vibrio cholerae]. Record created Aug. 2, 2018. 1 page. Retrieved Sep. 6, 2019 at URL: https://www.ncbi.nlm.nih.gov/protein/WP_114794357.1.

GenBank Accession No. WP_114808068. Version No. WP_114808068.1. cholix toxin [Vibrio cholerae]. Record created Aug. 2, 2018. 1 page. Retrieved Sep. 9, 2019 at URL: https://www.ncbi.nlm.nih.gov/protein/WP_114808068.1.

GenBank Accession No. WP_114967888. Version No. WP_114967888.1. cholix toxin [Vibrio cholerae]. Record created Aug. 3, 2018. 1 page. Retrieved Sep. 9, 2019 at URL: https://www.ncbi.nlm.nih.gov/protein/WP_114967888.1.

GenBank Accession No. WP_114974465. Version No. WP_114974465.1. cholix toxin [Vibrio cholerae]. Record created Aug. 3, 2018. 1 page. Retrieved Sep. 9, 2019 at URL: https://www.ncbi.nlm.nih.gov/protein/WP_114974465.1.

GenBank Accession No. WP_119788544. Version No. WP_119788544.1. cholix toxin [Vibrio cholerae]. Record created Sep. 26, 2018. 1 page. Retrieved Sep. 9, 2019 at URL: https://www.ncbi.nlm.nih.gov/protein/WP_119788544.1.

GenBank Accession No. WP_123013236. Version No. WP_123013236.1. cholix toxin [Vibrio cholerae]. Record created Nov. 10, 2018. 1 page. Retrieved Sep. 9, 2019 at URL: https://www.ncbi.nlm.nih.gov/protein/WP_123013236.1.

GenBank Accession No. WP_123162729. Version No. WP_123162729.1. cholix toxin [Vibrio cholerae]. Record created Nov. 14, 2018. 1 page. Retrieved Sep. 9, 2019 at URL: https://www.ncbi.nlm.nih.gov/protein/WP_123162729.1.

Hajishengallis et al. Type II Heat-labile Enterotoxins: Structure, Function, and Immunomodulatory Properties. Vet Immunol Immunopathol 152(1-2):68-77 (Mar. 15, 2013). doi:10.1016/j.vetimm.2012.09.034.

Han et al. Active Site Mutations of Pseudomonas aeruginosa Exotoxin A: Analysis of the HIS440 Residue. Journal of Biological Chemistry 270(2):679-684 (Jan. 13, 1995).

Hwang et al. Structure and function relationship of Pseudomonas exotoxin A. An immunochemical study. The Journal of Biological Chemistry 264(4):2379-2384 (1989).

IL248768 Office Action dated Jan. 14, 2020 (w/ English translation).

Jinno et al. Mutational analysis of domain 1 of Pseudomonas exotoxin. Mutations in domain I of Pseudomonas exotoxin which reduce cell binding and animal toxicity. The Journal of Biological Chemistry 263(26):13203-13207 (Sep. 15, 1988).

Johnson et al. Complete Genome Assemblies for Two Single-Chromosome Vibrio cholerae Isolates, Strains 1154-74 (Serogroup O49) and 10432-62 (Serogroup O27). Genome Announc 3(3):e00462-15 (May 14, 2015). 2 pages. doi:10.1128/genomeA.00462-15.

JP2013-529128 Office Action dated Sep. 1, 2015 (w/ English translation).

JP2017-511547 Office Action dated Nov. 27, 2019 (w/English machine translation).

JP2017-511547 Office Action dated Feb. 27, 2019 (w/ English translation).

Jørgensen, et al. Cholix toxin, a novel ADP-ribosylating factor from Vibrio cholerae. Journal of Biological Chemistry 283.16 (Apr. 18, 2008): 10671-10678.

Killeen, et al. Conformational integrity of a recombinant toxoid of Pseudomonas aeruginosa exotoxin A containing a deletion of glutamic acid-553. Biochimica et Biophysica Acta (BBA)—Molecular Basis of Disease 1138.2 (1992): 162-166.

Kondo et al. Activity of immunotoxins constructed with modified Pseudomonas exotoxin A lacking the cell recognition domain. J Biol Chem 263(19):9470-9475 (Jul. 5, 1988).

Kounnas, et al. The alpha 2-macroglobulin receptor/low density lipoprotein receptor-related protein binds and internalizes Pseudomonas exotoxin A. Journal of Biological Chemistry 267.18 (1992): 12420-12423.

Kumar et al. Genome Sequence of Non-O1 Vibrio cholerae PS15. Genome Announcements 1(1):e00227-12 (Jan./Feb. 2013). 2 pages.

Larkin et al. Calnuc Function in Endosomal Sorting of Lysosomal Receptors. Traffic 17:416-432 (2016). Uncorrected manuscript published online Jan. 12, 2016. Published online Feb. 12, 2016. DOI: 10.1111/tra.12374.

Laurent. Characterization of the trafficking pathway used by Pseudomonas aeruginosa Exotoxin A and application to oral drug delivery. Ph.D. Thesis. University of Bath. Dec. 2015. Retrieved Dec. 18, 2019 from URL: <https://purehost.bath.ac.uk/ws/portalfiles/portal/187920618/Thesis_F.Laurent_Dec2015.pdf>. 312 pages.

Leach et al. The Role of IL-10 in Inflammatory Bowel Disease: "Of Mice and Men." Toxicol Pathol 27(1):123-33 (1999).

Lin et al. Different Types of Cell Death Induced by Enterotoxins. Toxins 2:2158-2176 (Aug. 11, 2010). doi:10.3390/toxins2082158.

Lugo et al. The Father, Son and Cholix Toxin: The Third Member of the DT Group Mono-ADP-Ribosyltransferase Toxin Family. Toxins 7(8):2757-2772 (Jul. 24, 2015).

Luross et al. *Escherichia coli* Heat-Labile Enterotoxin B Subunit Prevents Autoimmune Arthritis Through Induction of Regulatory CD4+ T Cells. Arthritis & Rheumatism 46(6):1671-1682 (Jun. 6, 2002). DOI 10.1002/art.10328.

Mahato et al. Emerging trends in oral delivery of peptide and protein drugs. Crit Rev Ther Drug Carrier Syst. 2003;20(2-3):153-214.

Mattoo et al. Interactions of bacterial effector proteins with host proteins. Curr Opin Immunol. Aug. 2007;19(4):392-401.

Mekalanos et al. Cholera toxin genes: nucleotide sequence, deletion analysis and vaccine development. Nature 306:551-557 (1983).

Merritt et al. Crystal structure of cholera toxin B-pentamer bound to receptor GM1 pentasaccharide. Protein Science 3:166-175 (1994).

Milling et al. Regulation of intestinal immunity: Effects of the oral adjuvant *Escherichia coli* heat-labile enterotoxin on heat-labile enterotoxin on migrating dendritic cells. Eur. J. Immunol. 37:87-99 (2007). DOI 10.1002/eji.200636199.

Mitamura, et al., "Diphtheria Toxin Binds to the Epidermal Growth Factor (EGF)-like Domain of Human Heparin-binding EGF-like Growth Factor/Diphtheria Toxin Receptor and Inhibits Specifically Its Mitogenic Activity," J Biol Chem 270(3):1015-1019 (1995).

Mrsny, et al. Bacterial toxins as tools for mucosal vaccination. Drug Discovery Today. 2002; 4:247-258.

(56) References Cited

OTHER PUBLICATIONS

Mrsny et al. Mucosal administration of a chimera composed of Pseudomonas exotoxin and the gp120 V3 loop sequence of HIV-1 induces both salivary and serum antibody responses. Vaccine 17(11-12):1425-1433 (Mar. 17, 1999).
Mrsny, Lessons from nature: "Pathogen-Mimetic" systems for Mucosal Nano-medicines, Advanced Drug Delivery Reviews, vol. 61 :172-192 (online Dec. 24, 2008).
Mrsny. Permeation of barriers for GI and pulmonary drug delivery. (Presentation.) Gordon Research Conference, New Hampshire, United States. (Dec. 8, 2013.) 46 pages.
Mudrak et al. Heat-Labile Enterotoxin: Beyond GM1 Binding. Toxins 2:1445-1470 (Jun. 14, 2010). doi:10.3390/toxins2061445.
Nagalakshmi et al. Interleukin-22 activates STAT3 and induces IL-10 by colon epithelial cells. International Immunopharmacology 4:679-691 (2004).
Narang, et al. Improved phosphotriester method for the synthesis of gene fragments. Methods Enzymol. 1979;68:90-8.
Nashar et al. Modulation of B-cell activation by the B subunit of *Escherichia coli* enterotoxin: receptor interaction up-regulates MHC class II, B7, CD40, CD25 and ICAM-1. Immunology 91:572-578 (1997).
Nashar et al. Potent immunogenicity of the B subunits of *Escherichia coli* heat-labile enterotoxin: Receptor binding is essential and induces differential modulation of lymphocyte subsets. Proc Natl Acad Sci USA 93:226-230 (Jan. 1996).
Notice of Allowance dated May 11, 2015 for U.S. Appl. No. 13/822,435.
Office action dated Apr. 8, 2016 for U.S. Appl. No. 14/733,940.
Office action dated May 4, 2017 for U.S. Appl. No. 14/733,946.
Office action dated Jun. 12, 2014 for U.S. Appl. No. 13/822,435.
Office action dated Jun. 13, 2017 for U.S. Appl. No. 14/733,940.
Office action dated Jul. 8, 2015 for U.S. Appl. No. 14/733,940.
Office action dated Sep. 9, 2016 for U.S. Appl. No. 14/733,946.
Office action dated Oct. 19, 2017 for U.S. Appl. No. 15/309,177.
Office action dated Dec. 2, 2013 for U.S. Appl. No. 13/822,435.
Office action dated Dec. 30, 2015 for U.S. Appl. No. 14/733,946.
Ola et al. Protection of non-obese diabetic mice from autoimmune diabetes by *Escherichia coli* heat-labile enterotoxin B subunit. Immunology 117:262-270 (2005). doi:10.1111/j.1365-2567.2005.02294.x.
Pai et al. Anti-tumor activities of immunotoxins made of monoclonal antibody B3 and various forms of Pseudomonas exotoxin. Proc Natl Acad Sci U S A 88:3358-3362 (Apr. 1991).
Pastan et al. Recombinant Toxins as Novel Therapeutic Agents. Annu Rev Biochem 61:331-54 (1992).
PCT International Search Report and Written Opinion dated Feb. 6, 2012 for PCT/US2011/001602.
PCT International Search Report and Written Opinion dated Nov. 13, 2015 for PCT/US2015/29795.
PCT/US2019/021474 International Search Report and Written Opinion dated Jun. 11, 2019.
PCT/US2019/050708 International Search Report and Written Opinion dated Nov. 19, 2019.
Pitman et al. Receptor mediated apoptosis of CD8+T cells by the B subunits of cholera-like enterotoxins. Biochemical Society Transactions 26:S338 (1998). One page.
Plant et al. Modulation of the Immune Response by the Cholera-like Enterotoxins. Current Topics in Medicinal Chemistry 4:509-519 (2004).
Plant et al. The B subunit of *Escherichia coli* heat labile enterotoxin abrogates oral tolerance, promoting predominantly Th2-type immune responses. Eur J Immunol 33:3186-3195 (2003).
Purdy et al. A Glimpse into the Expanded Genome Content of Vibrio cholerae through Identification of Genes Present in Environmental Strains. Journal of Bacteriology 187(9):2992-3001 (May 2005). DOI: 10.1128/JB.187.9.2992-3001.2005.
Purdy et al. Diversity and distribution of cholix toxin, a novel ADP-ribosylating factor from Vibrio cholerae. Environmental Microbiology Reports 2(1):198-207 (Feb. 2010). First published Feb. 8, 2010. DOI: https://doi.org/10.1111/j.1758-2229.2010.00139.x.
Raveney et al. The B Subunit of *Escherichia coli* Heat-Labile Enterotoxin Inhibits Th1 but Not Th17 Cell Responses in Established Experimental Autoimmune Uveoretinitis. Investigative Ophthalmology & Visual Science 49(9):4008-4017 (Sep. 2008).
Rodighiero, et al. Structural Basis for the Differential Toxicity of Cholera Toxin and *Escherichia coli* Heat-labile Enterotoxin. The Journal of Biological Chemistry 274.77 (1999): 3962-3969.
RU2016147734 Office Action dated Dec. 24, 2019 (w/ English translation).
RU2016147734 Office Action dated May 28, 2019 (w/ English translation).
Rubas et al. An integrated method to determine epithelial transport and bioactivity of oral drug candidates in vitro. Pharm Res 13(1):23-26 (Jan. 1996).
Rubas et al. Comparison of the permeability characteristics of a human colonic epithelial (Caco-2) cell line to colon of rabbit, monkey, and dog intestine and human drug absorption. Pharm Res.10(1):113-118 (1993).
Rubas et al. Flux Measurements across Caco-2 Monolayers May Predict Transport in Human Large Intestinal Tissue. J Pharm Sci 85(2):165-169 (Feb. 1996).
Ruddock et al. Assembly of the B Subunit Pentamer of *Escherichia coli* Heat-labile Enterotoxin. J Biol Chem 271(32):19118-19123 (Aug. 9, 1996).
Ruddock et al. Kinetics of Acid-mediated Disassembly of the B Subunit Pentamer of *Escherichia coli* Heat-labile Enterotoxin. J Biol Chem 270(50):29953-29958 (Dec. 15, 1995).
Saidi et al. Prevalence of Vibrio cholerae O1 El Tor variant in a cholera-endemic zone of Kenya.Journal of Medical Microbiology 63:415-420 (2014). First published online Mar. 1, 2014. doi:10.1099/jmm.0.068999-0.
Salmond et al. The B Subunit of *Escherichia coli* Heat-Labile Enterotoxin Induces Both Caspase-Dependent and -Independent Cell Death Pathways in CD8+ T Cells. Infection and Immunity 72(10):5850-5857 (Oct. 2004).
Schauer. AVX-470, an Orally-Delivered GI-Targeted anti-TNF for the Treatment of Pediatric IBD. Presentation. Avaxia Biologies (Oct. 26, 2015). 42 pages.
Siegall et al. Functional Analysis of Domains II, Ib, and III of Pseudomonas Exotoxin. J Biol Chem 264(24):14256-14261 (Aug. 25, 1989).
Simmons et al. Immunomodulation Using Bacterial Enterotoxins. Scand J Immunol 53:518-226 (2001).
Simon, et al. Novel bacterial ADP-ribosylating toxins: structure and function. Nature Reviews Microbiology 12.9 (2014): 599-611.
Soriani et al. *Escherichia coli* Enterotoxin B Subunit Triggers Apoptosis of CD8+ T Cells by Activating Transcription Factor c-Myc. Infection and Immunity 69(8):4923-4930 (Aug. 2001).
Spooner et al. Retrograde transport pathways utilised by viruses and protein toxins. Virology Journal, 3:26 (2006).
Sun et al. Cholera toxin B subunit: An efficient transmucosal carrier-delivery system for induction of peripheral immunological tolerance. Proc Natl Acad Sci USA 91:10795-10799 (Nov. 1994).
Taupiac et al. A deletion within the translocation domain of Pseudomonas exotoxin A enhances translocation efficiency and cytotoxicity concomitantly. Molecular Microbiology 31(5):1385-1393 (1999).
Taverner et al. Cholix protein domain I functions as a carrier element for efficient apical to basal epithelial transcytosis. Tissue Barriers, pp. 1710429-1 to 1710429-1 (Jan. 13, 2020). doi: 10.1080/21688370.2019.1710429.
Taverner, et al. Enhanced paracellular transport of insulin can be achieved via transient induction of myosin light chain phosphorylation. Journal of Controlled Release 210 (2015): 189-197.
Turcanu et al. Modulation of human monocytes by *Escherichia coli* heat-labile enterotoxin B-subunit; altered cytokine production and its functional consequences. Immunology 106:316-325 (2002).
U.S. Appl. No. 15/616,140 Notice of Allowance dated Aug. 28, 2018.
U.S. Appl. No. 16/207,655 Office Action dated Feb. 19, 2019.
U.S. Appl. No. 15/309,177 Notice of Allowance dated Dec. 13, 2019.

(56) References Cited

OTHER PUBLICATIONS

U.S. Appl. No. 15/309,177 Notice of Allowance dated Mar. 8, 2019.
U.S. Appl. No. 15/309,177 Notice of Allowance dated Nov. 2, 2018.
U.S. Appl. No. 15/309,177 Office Action dated Aug. 24, 2018.
U.S. Appl. No. 15/309,177 Office Action dated Mar. 16, 2018.
U.S. Appl. No. 16/151,533 Office Action dated Feb. 18, 2020.
U.S. Appl. No. 16/207,611 Notice of Allowance dated Dec. 13, 2019.
U.S. Appl. No. 16/207,611 Office Action dated Mar. 14, 2019.
U.S. Appl. No. 16/207,637 Notice of Allowance dated Dec. 13, 2019.
U.S. Appl. No. 16/207,637 Office Action dated Mar. 14, 2019.
U.S. Appl. No. 16/207,655 Office Action dated Aug. 30, 2019.
U.S. Appl. No. 16/207,655 Office Action dated Dec. 6, 2019.
U.S. Appl. No. 16/220,923 Office Action dated Dec. 9, 2019.
U.S. Appl. No. 16/220,923 Office Action dated Mar. 12, 2019.
U.S. Appl. No. 16/414,671 Notice of Allowance dated Dec. 10, 2019.
U.S. Appl. No. 16/414,686 Notice of Allowance dated Dec. 5, 2019.
U.S. Appl. No. 15/309,177 Office Action dated Jun. 25, 2019.
U.S. Appl. No. 16/151,533 Notice of Allowance dated May 28, 2020.
U.S. Appl. No. 16/207,655 Notice of Allowance dated May 20, 2020.
U.S. Appl. No. 16/207,655 Office Action dated Feb. 28, 2019.
U.S. Appl. No. 16/220,923 Notice of Allowance dated May 20, 2020.
Wedekind et al. Refined crystallographic structure of Pseudomonas aeruginosa exotoxin A and its implications for the molecular mechanism of toxicity. J Mol Biol. Dec. 7, 2001;314(4):823-37.
Weldon, et al. A guide to taming a toxin-recombinant immunotoxins constructed from Pseudomonas exotoxin A for the treatment of cancer. FEBS Journal 278.23 (2011): 4683-4700.
Woodley, J.F. Enzymatic barriers for GI peptide and protein delivery. Crit Rev Ther Drug Carrier Syst. 1994;11(2-3):61-95.
Xia et al. Tyrphostin-8 Enhances Transferrin Receptor-Mediated Transcytosis in Caco-2 Cells and Increases Hypoglycemic Effect of Orally Administered Insulin-Transferrin Conjugate in Diabetic Rats. Pharmaceutical Res 18(2):191-195 (Feb. 2001).
Yates, et al. Stealth and Mimicry by Deadly Bacterial Toxins. Trends Biochemical Science 31 (2006): 123-133.
Zdanov et al. Crystal structure of interleukin-10 reveals the functional dimer with an unexpected topological similarity to interferon γ. Structure 3(6):591-601 (Jun. 15, 1995).
Zdanov. Structural analysis of cytokines comprising the IL-10 family. Cytokine & Growth Factor Reviews 21(5):325-330 (Oct. 2010). Available online Sep. 16, 2010. DOI: https://doi.org/10.1016/j.cytogfr.2010.08.003.
Co-pending U.S. Appl. No. 17/558,418, inventors Mrsny; Randall J. et al., filed Dec. 21, 2021.
GenBank Accession No. AY876053. Version No. AY876053.1. Vibrio cholerae strain TP hypothetical protein gene, partial cds; hypothetical exotoxin A (toxA) gene, complete cds; and hypothetical protein gene, partial cds. Record created Feb. 9, 2005. 2 pages. Retrieved Sep. 28, 2021 at URL: https://www.ncbi.nlm.nih.gov/nuccore/AY876053.
Seq Id No. 1 of U.S. Publication No. 2003-0186386 dated Oct. 2, 2003. Provided labeled WO 01/58950 (published Aug. 16, 2001). 2 pages.

\* cited by examiner

1: SEQ ID NO: 190
2: SEQ ID NO: 150

MVEEALNIFDECRSPCSLTPEPGKPIQSKLSIPSDVVLDEGVLYYSMTINDEQNDIKDED
KGESIITIGEFATVRATRHYVNQDAPFGVIHLDITTENGTKTYSYNRKEGEFAINWLVPI
GEDSPASIKISVDELDQQRNIIEVPKLYSIDLDNQTLEQWKTQGNVSFSVTRPENNIAIS
WPSVSYKAAQKEGSRHKRWAHWHTGLALCWLVPMDAIYNYITQQNCTLGDNWFGGSYETV
AGTPKVITVKQGIEQKPVEQRIHFSK (SEQ ID NO: 178)
FIG. 21A
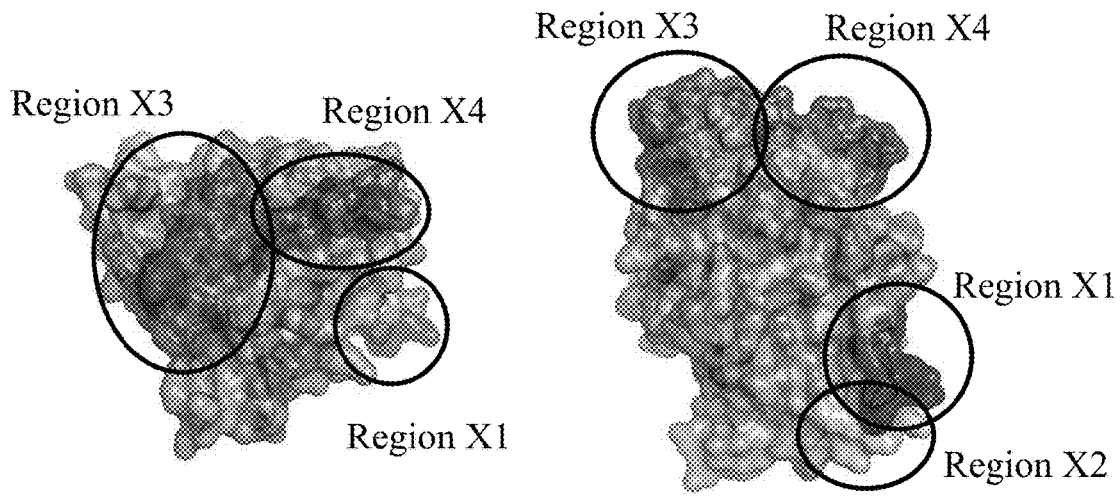
FIG. 21B
FIG. 21C
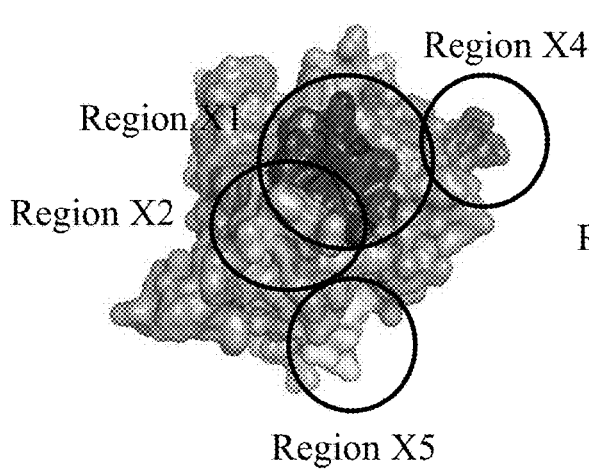
FIG. 21D
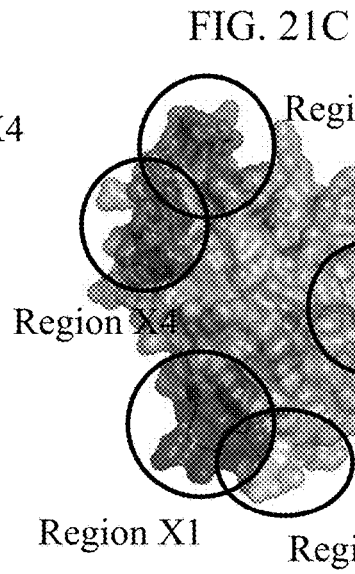
FIG. 21E

US 11,324,833 B2

CHOLIX-DERIVED CARRIERS FOR ORAL DELIVERY OF HETEROLOGOUS PAYLOAD

CROSS-REFERENCE

This application is a continuation application of International Patent Application No. PCT/US2019/050708, filed Sep. 11, 2019, which claims the benefit of U.S. Provisional Application Nos. 62/888,144, filed Aug. 16, 2019; 62/888,400, filed Aug. 16, 2019; 62/888,133, filed Aug. 16, 2019; 62/816,022, filed Mar. 8, 2019; and 62/756,889 filed Nov. 7, 2018, which applications are incorporated herein by reference in their entirety for all purposes.

SEQUENCE LISTING

The instant application contains a Sequence Listing which has been submitted electronically in ASCII format and is hereby incorporated by reference in its entirety. Said ASCII copy, created on Dec. 20, 2019, is named 40566-722_301_SL.txt and is 835,387 bytes in size.

BACKGROUND

The gut epithelium has thwarted efforts to orally administer large therapeutic molecules such as proteins because proteins cannot diffuse across the intact epithelial barrier or cross the barrier through the tight junctions. Once taken up by an epithelial cell, a therapeutic protein either enters the destructive lysosomal trafficking pathway or is released back into the intestinal lumen. This inability to be readily transported across the intestinal epithelium continues to be a limiting factor in developing commercially viable oral formulations, particularly for polypeptide-based therapeutics. A common solution is to use parenteral administration such as intravenous or subcutaneous administration, but these administration routes can often create considerable side effects, lower the therapeutic efficacy, and reduce patient convenience that can negatively affect compliance. There is a need for improved compositions and methods for transporting therapeutics into or across an epithelium, e.g., a gut epithelium.

INCORPORATION BY REFERENCE

All publications, patents, and patent applications mentioned in this specification are herein incorporated by reference to the same extent as if each individual publication, patent, or patent application was specifically and individually indicated to be incorporated by reference.

SUMMARY

In one aspect, the present disclosure provides a carrier-payload complex comprising a carrier capable of endocytosing into a polarized epithelial cell and accumulating in a region of the cell, wherein the payload is heterologous to the carrier. In some embodiments, the region is an apical compartment, a supranuclear compartment, or a basal compartment. In some embodiments, the carrier is retained in the region for at least 5 mins, 10 mins, or 15 minutes in the region. In some embodiments, the carrier is derived from a Cholix polypeptide. In some embodiments, the carrier is a polypeptide having a Cholix sequence with a C-terminus at any one of positions 150-195. In some embodiments, the carrier is a polypeptide having a Cholix sequence with an N-terminus at any one of positions 1-41. In some embodiments, the carrier is a polypeptide having a Cholix sequence with an N-termination truncation at any one of positions 35-40. In some embodiments, the carrier is a polypeptide having a Cholix sequence with a C-terminus at any one of positions 150-205. In some embodiments, the carrier consists of the amino acid residues from the N-terminal position 40 to any one of the C-terminal positions 150-205 of the sequence set forth in SEQ ID NO: 130. In some embodiments, the carrier has a C-terminus at positions 150 or 187 of the sequence set forth in SEQ ID NO: 130. In some embodiments, the carrier consists of the amino acid sequence set forth in SEQ ID NO: 137. In some embodiments, the carrier consists of the amino acid sequence set forth in any one of SEQ ID NOs: 137-139. In some embodiments, position numbering is based on alignment of the Cholix polypeptide to the sequence set forth in SEQ ID NO: 130, wherein positions are numbered from an N-terminus to a C-terminus starting with position 1 at the N-terminus. In some embodiments, the carrier is capable of remaining associated with an apical entry receptor longer following endocytosis of the carrier into the polarized epithelial cell than a carrier capable of transcytosing across the polarized epithelial cell. In some embodiments, the apical entry receptor is a TMEM132 receptor. In some embodiments, the polarized epithelial cell comprises a gastrointestinal polarized epithelial cell.

In one aspect, the present disclosure provides a carrier-payload complex comprising (i) a carrier derived from a Cholix polypeptide having a C-terminus at any of positions 195-347 and capable of transcytosing across a polarized epithelial cell, coupled to (ii) a heterologous payload. In some embodiments, position numbering is based on alignment of the Cholix polypeptide to the sequence set forth in SEQ ID NO: 130, wherein positions are numbered from an N-terminus to a C-terminus starting with position 1 at the N-terminus. In some embodiments, the C-terminus is at any one of positions 195-266. In some embodiments, the C-terminus is at any one of the positions 195-266 of any one of the sequences set forth in SEQ ID NOs: 1-2, or 4-78. In some embodiments, the C-terminus is at any one of positions 206, 245, 251, or 266 a sequence set forth in SEQ ID NO: 130. In some embodiments, the C-terminus is at any one of positions 206, 245, 251, or 266 of SEQ ID NOs: 1-2, or 4-78. In some embodiments, the C-terminus is at position 206 of any one of SEQ ID NOs: 1-2, or 4-78. In some embodiments, the carrier consists of the amino acid sequence set forth in SEQ ID NOs: 131 or 184. In some embodiments, the C-terminus is at position 245 of any one of SEQ ID NOs: 1-2, or 4-78. In some embodiments, the carrier consists of the amino acid sequence set forth in SEQ ID NOs: 132 or 183. In some embodiments, the C-terminus is at position 251 of SEQ ID NOs: 1-2, or 4-78. In some embodiments, the carrier consists of the amino acid sequence set forth in SEQ ID NOs: 133 or 182. In some embodiments, the C-terminus is at position 266 of SEQ ID NOs: 1-2, or 4-78. In some embodiments, the carrier consists of the amino acid sequence set forth in SEQ ID NOs: 134 or 181. In some embodiments, the carrier consists of the sequence set forth in SEQ ID NOs: 1-2, or 4-78 with truncation at any one of the positions 195-347, and has no more than 5, 4, 3, 2, or 1 amino acid variations at any of positions 1-40, 133-151, 152-187, or 188-206 of SEQ ID NOs: 1-2, or 4-78.

In one aspect, the present disclosure provides a carrier-payload complex comprising (i) a carrier derived from a Cholix polypeptide comprising an amino acid sequence set forth in any one of SEQ ID NOs: 1-2, 4-125, or 127-129, or a fragment thereof capable of endocytosis into a polarized epithelial cell or transcytosis of a polarized epithelial cell, coupled to (ii) a heterologous payload. In some embodiments, the carrier comprises a glutamic acid at position 3 and an alanine at position 4. In some embodiments, the carrier is non-toxic. In some embodiments, the carrier is capable of transcytosing the heterologous payload across a polarized epithelial cell. In some embodiments, the carrier comprises a fragment capable of transcytosis of a polarized epithelial cell, wherein the carrier has a C-terminus at any one of the positions 195 to a C-terminal residue of the sequence set forth in any one of SEQ ID NOs: 1-2, or 4-78. In some embodiments, the C-terminus is at any one of the positions 195-386 of the sequence set forth in any one of SEQ ID NOs: 1-2, or 4-78. In some embodiments, the C-terminus is at position 386 of any one of the sequences set forth in SEQ ID NOs: 1-2, or 4-78. In some embodiments, the C-terminus is at position 386 of any one of the sequences set forth in SEQ ID NOs: 1-2. In some embodiments, the carrier consists of the amino acid sequence set forth in SEQ ID NO: 135.

In one aspect, the present disclosure provides a carrier-payload complex comprising (i) a carrier derived from a Cholix polypeptide that does not comprise SEQ ID NO: 179, and does not consist of SEQ ID NO: 126, complexed with (ii) a heterologous payload, wherein the carrier is capable of (a) transcytosing the heterologous payload across a polarized epithelial cell; or (b) transporting the heterologous payload into the polarized epithelial cell. In some embodiments, the carrier comprises at least 75% sequence identity to a sequence set forth in SEQ ID NO: 130, or fragment thereof. In some embodiments, the carrier comprises at least 90% sequence identity to a Cholix variant set forth in SEQ ID NO: 130, or a fragment thereof. In some embodiments, the Cholix polypeptide is a sequence set forth in SEQ ID NO: 130, or fragment thereof. In some embodiments, the carrier comprises a glutamic acid at position 3 and an alanine at position 4. In some embodiments, the carrier is non-toxic. In some embodiments, the carrier is capable of transcytosing the heterologous payload across the polarized epithelial cell. In some embodiments, the carrier has a C-terminal truncation at any one of the positions 195-633 of the sequence set forth in SEQ ID NO: 130. In some embodiments, the C-terminal truncation is at any one of the positions 195-386 of the sequence set forth in SEQ ID NO: 130. In some embodiments, the carrier has a C-terminal truncation at any one of the positions 195-386 of any one of the sequences set forth in SEQ ID NOs: 1-2, or 4-78. In some embodiments, the C-terminal truncation is at position 386 of any one of the sequences set forth in SEQ ID NOs: 1-2, or 4-78. In some embodiments, the C-terminal truncation is at position 386 of any one of the sequences set forth in SEQ ID NOs: 1-2. In some embodiments, the carrier-payload complex comprises an N-terminal methionine. In some embodiments, the carrier is synthetically conjugated to the heterologous payload. In some embodiments, the carrier is genetically fused to the heterologous payload. In some embodiments, the heterologous payload is a therapeutic payload. In some embodiments, the therapeutic payload is a cytokine, an antibody, a hormone, or a nucleic acid. In some embodiments, the therapeutic payload is a cytokine. In some embodiments, the cytokine is an interleukin. In some embodiments, the interleukin is an IL-10. In some embodiments, the IL-10 comprises an amino acid sequence having at least 90% sequence identity to the amino acid sequence set forth in SEQ ID NO: 145. In some embodiments, the interleukin is an IL-22. In some embodiments, the IL-22 comprises an amino acid sequence having at least 90% sequence identity to the amino acid sequence set forth in SEQ ID NO: 142. In some embodiments, the therapeutic payload is an antibody. In some embodiments, the antibody is an anti-TNF antibody. In some embodiments, the therapeutic payload is a hormone. In some embodiments, the therapeutic payload is a human growth hormone. In some embodiments, the heterologous payload is covalently coupled to the carrier. In some embodiments, the heterologous payload is coupled to a C-terminus of the carrier. In some embodiments, the heterologous payload is coupled to an N-terminus of the carrier. In some embodiments, the carrier is coupled to the heterologous payload via a spacer. In some embodiments, the spacer is a non-cleavable spacer. In some embodiments, the spacer comprises between 1 and 100 amino acid residues. In some embodiments, the spacer comprises up to 15 repeats of GS (SEQ ID NO: 169), GGS (SEQ ID NO: 170), GGGS (SEQ ID NO: 171), GGGGS (SEQ ID NO: 172), GGGGGS (SEQ ID NO: 173), or a combination thereof. In some embodiments, the spacer comprises an amino acid sequence set forth in SEQ ID NO: 175. In some embodiments, the spacer consists of the amino acid sequence set forth in SEQ ID NO: 176. In some embodiments, the heterologous payload is non-covalently coupled to the carrier. In some embodiments, the heterologous payload is complexed to the carrier via a nanoparticle.

In one aspect, the present disclosure provides a method of transcytosing a heterologous payload across a polarized epithelial cell, comprising: (a) contacting an apical membrane of the polarized epithelial cell with a carrier-payload complex; and (b) transcytosing the carrier-payload complex across the polarized epithelial cell, wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the polarized epithelial cell, coupled to the heterologous payload. In some embodiments, contacting the apical membrane of the polarized epithelial cell with the carrier-payload complex comprises interacting of the carrier with the apical entry receptor TMEM132. In some embodiments, interacting of the carrier with the membrane protein TMEM132 results in receptor-mediated endocytosis of the carrier-payload complex. In some embodiments, the carrier that interacts with TMEM132 comprises the amino acid residues 135-151 of SEQ ID NO: 130, or a sequence having at least 90% sequence identity thereto. In some embodiments, the transcytosing of the carrier-payload complex across the polarized epithelial cell comprises interacting of the carrier with any one or more of GRP75, ERGIC-53, and perlecan. In some embodiments, the transcytosing of the carrier-payload complex across the polarized epithelial cell further comprises co-localization of the carrier-payload complex with any one or more of COPI, EEA1, and Rab7 at the apical side, and with Rab11a at the basal side of the epithelial cell. In some embodiments, the carrier that interacts with GRP7 or ERGIC-53 comprises the amino acid residues 1-40 and 152-187 of SEQ ID NO: 130, or a sequence having at least 90% sequence identity thereto. In some embodiments, the carrier that interacts with perlecan comprises the amino acid residues 188-205 of SEQ ID NO: 130, or a sequence having at least 90% sequence identity thereto. In some embodiments, the method can further comprise, subsequent to (b) delivering the carrier-payload complex into the lamina propria. In some embodiments, the polarized epithelial cell is a polarized gut epithelial cell.

In one aspect, the present disclosure provides a method of orally delivering a heterologous payload to a subject, comprising: orally administering a carrier-payload complex to the subject, wherein the carrier is capable of transcytosing the carrier-payload complex across a polarized epithelium, thereby delivering the heterologous payload to the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the epithelium, coupled to the heterologous payload.

In one aspect, the present disclosure provides a carrier-payload complex for orally delivering a heterologous payload to a subject by a method comprising: orally administering the carrier-payload complex to the subject, wherein the carrier is capable of transcytosing the carrier-payload complex across a polarized epithelium, thereby treating a disease the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the epithelium, coupled to the heterologous payload.

In one aspect, the present disclosure provides a use of a carrier-payload complex for orally delivering a heterologous payload to a subject by a method comprising: orally administering the carrier-payload complex to the subject; wherein the carrier is capable of transcytosing the carrier-payload complex across a polarized epithelium, thereby treating a disease in the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the epithelium, coupled to the heterologous payload.

In one aspect, the present disclosure provides a method of treating a disease in a subject, comprising: orally administering a carrier-payload complex to the subject, wherein the carrier is capable of transcytosing the carrier-payload complex across a polarized epithelium, thereby treating a disease in the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the epithelium, coupled to the heterologous payload.

In one aspect, the present disclosure provides a carrier-payload complex for use in treating a disease in a subject by a method comprising: orally administering the carrier-payload complex to the subject, wherein the carrier is capable of transcytosing the carrier-payload complex across a polarized epithelium, thereby treating the disease in the subject, and wherein the carrier-payload complex comprises a carrier derived from a Cholix polypeptide having an amino acid sequence e set forth in any one of SEQ ID NOs: 1-2, 4-125, or 127-129, or a fragment thereof capable of transcytosing the carrier-payload complex across the epithelium, coupled to the heterologous payload.

In one aspect, the present disclosure provides a use of a carrier-payload complex in the manufacture of a medicament for treating a disease in a subject by a method comprising: orally administering the carrier-payload complex to the subject, wherein the carrier is capable of transcytosing the carrier-payload complex across a polarized epithelium, thereby treating the disease in the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the epithelium, coupled to the heterologous payload. In some embodiments, the method further comprises binding of the heterologous payload to a receptor in the lamina propria. In some embodiments, the method further comprises delivering the heterologous payload into systemic circulation. In some embodiments, the carrier is a Cholix derived polypeptide. In some embodiments, the carrier comprises amino acid residues 1-206, 1-245, 1-251, 1-266, or 1-386 of the sequence set forth in SEQ ID NO: 130. In some embodiments, the carrier comprises amino acid residues 1-206, 1-245, 1-251, 1-266, or 1-386 of the sequence set forth in SEQ ID NOs: 1-2. In some embodiments, the carrier comprises any one of the amino acid sequences set forth in SEQ ID NOs: 131-135 or 180-184. In some embodiments, the polarized epithelium is a polarized gut epithelium. In some embodiments, the disease is ulcerative colitis, pouchitis, proctitis, Crohn's disease, Multiple sclerosis (MS), Systemic lupus erythematosus (SLE), Graft versus host disease (GVHD), Rheumatoid arthritis, or Psoriasis. In some embodiments, the disease is ulcerative colitis. In some embodiments, the ulcerative colitis is mild-to-moderate or moderate to severe. In some embodiments, the disease is Crohn's disease. In some embodiments, the Crohn's disease is Fistulizing Crohn's disease. In some embodiments, the payload is an interleukin. In some embodiments, the interleukin comprises the amino acid sequence of SEQ ID NOs: 142 or 145.

In one aspect, the present disclosure provides a method of transporting a heterologous payload into a polarized epithelial cell, comprising: (a) contacting the apical membrane of the polarized epithelial cell with a carrier-payload complex; and (b) transporting the carrier-payload complex into the polarized epithelial cell, wherein the carrier-payload complex comprises a carrier derived from a Cholix polypeptide having an amino acid sequence set forth in any one of SEQ ID NOs: 1-2, 4-125, or 127-129, or a fragment thereof capable of transporting the carrier-payload complex into the epithelial cell, coupled to the heterologous payload. In some embodiments, contacting the apical membrane of the polarized epithelial cell with the carrier-payload complex comprises interacting of the carrier with the apical entry receptor TMEM132. In some embodiments, interacting of the carrier with the apical entry receptor TMEM132 results in receptor-mediated endocytosis of the carrier-payload complex. In some embodiments, the method further comprises transporting the heterologous payload to an apical compartment or a basal compartment. In some embodiments, the carrier of the carrier-payload complex remains associated with TMEM132 after endocytosis. In some embodiments, the carrier that interacts with TMEM132 comprises amino acid residues 135-151 of SEQ ID NO: 130, or a sequence having at least 90% sequence identity thereto. In some embodiments, the carrier is a Cholix derived polypeptide. In some embodiments, the carrier consists of amino acid residues 1-151, 1-187, 41-187, or 40-205 of a sequence set forth in SEQ ID NO: 130. In some embodiments, the carrier consists of amino acid residues 1-151, 1-187, 41-187, or 40-205 of the sequence set forth in SEQ ID NOs: 1-2. In some embodiments, the carrier consists of any one of the amino acid sequences set forth in SEQ ID NOs: 136-139. In some embodiments, the carrier is non-covalently coupled to the heterologous payload via a nanoparticle. In some embodiments, a ratio of the heterologous payload to the carrier on the nanoparticle is at least 15,000:1. In some embodiments, the heterologous payload is a glucose-lowering agent. In some embodiments, the glucose-lowering agent is noncovalently associated with the nanoparticle. In some embodiments, the heterologous payload is an siRNA. In some embodiments, the siRNA is non-covalently associated with the nanoparticle. In some embodiments, the carrier is covalently-linked to the nanoparticle or is spray-dried on the nanoparticle.

In one aspect, the present disclosure provides a method comprising transporting a heterologous payload into a polarized epithelial cell, comprising: (a) contacting the apical membrane of the polarized epithelial cell with a carrier-payload complex; and (b) transporting the carrier-payload complex into the polarized epithelial cell, wherein the carrier-payload complex is the carrier-payload complex comprising any of the endocytosing carriers herein.

In one aspect, the disclosure includes a carrier-payload complex comprising a carrier capable of accumulating in an apical compartment of a polarized epithelial cell at least 5 minutes after endocytosis of the carrier, coupled to a heterologous payload.

In some embodiments, the carrier is capable of accumulating in the apical compartment of the polarized epithelial cell at least 10 minutes after endocytosis of the carrier. In some embodiments, the carrier is capable of accumulating in the apical compartment of the polarized epithelial cell at least 15 minutes after endocytosis of the carrier.

In some embodiments, the polarized epithelial cell comprises a gastrointestinal polarized epithelial cell. In some embodiments, the polarized epithelial cell comprises a rat gastrointestinal polarized epithelial cell.

In another aspect, the disclosure includes a carrier-payload complex comprising a carrier capable of accumulating in an apical compartment of a polarized epithelial cell at least 5 minutes after intraluminal application of the carrier to a gastrointestinal tract of a mammal, coupled to a heterologous payload.

In some embodiments, the carrier is capable of accumulating in the apical compartment of the polarized epithelial cell at least 10 minutes after intraluminal application of the carrier to the gastrointestinal tract of the mammal. In some embodiments, the carrier is capable of accumulating in the apical compartment of polarized epithelial cell at least 15 minutes after intraluminal application of the carrier to the gastrointestinal tract carrier of the mammal.

In some embodiments, the intraluminal application comprises intraluminal injection into a rat jejunum.

In another aspect, the disclosure includes a carrier-payload complex comprising a carrier capable of accumulating in a supranuclear compartment of a polarized epithelial cell at least 5 minutes after endocytosis of the carrier, coupled to a heterologous payload.

In some embodiments, the carrier is capable of accumulating in the supranuclear compartment of the polarized epithelial cell at least 10 minutes after endocytosis of the carrier. In some embodiments, the carrier is capable of accumulating in the supranuclear compartment of the polarized epithelial cell at least 15 minutes after endocytosis of the carrier.

In some embodiments, the polarized epithelial cell comprises a gastrointestinal polarized epithelial cell. In some embodiments, the polarized epithelial cell comprises a rat gastrointestinal polarized epithelial cell.

In another aspect, the disclosure includes a carrier-payload complex comprising a carrier capable of accumulating in a supranuclear compartment of a polarized epithelial cell at least 5 minutes after intraluminal application of the carrier to a gastrointestinal tract of a mammal, coupled to a heterologous payload.

In some embodiments, the carrier is capable of accumulating in the supranuclear compartment of the polarized epithelial cell at least 10 minutes after intraluminal application of the carrier to the gastrointestinal tract of the mammal. In some embodiments, the carrier is capable of accumulating in the supranuclear compartment of polarized epithelial cell at least 15 minutes after intraluminal application of the carrier to the gastrointestinal tract carrier of the mammal.

In some embodiments, the intraluminal application comprises intraluminal injection into a rat jejunum.

In another aspect, the disclosure includes a carrier-payload complex comprising a carrier capable of accumulating in a basal compartment of a polarized epithelial cell at least 5 minutes after endocytosis of the carrier, coupled to a heterologous payload.

In some embodiments, the carrier is capable of accumulating in the basal compartment of the polarized epithelial cell at least 10 minutes after endocytosis of the carrier. In some embodiments, the carrier is capable of accumulating in the basal compartment of the polarized epithelial cell at least 15 minutes after endocytosis of the carrier.

In some embodiments, the polarized epithelial cell comprises a gastrointestinal polarized epithelial cell. In some embodiments, the polarized epithelial cell comprises a rat gastrointestinal polarized epithelial cell.

In another aspect, the disclosure includes a carrier-payload complex comprising a carrier capable of accumulating in a basal compartment of a polarized epithelial cell at least 5 minutes after intraluminal application of the carrier to a gastrointestinal tract of a mammal, coupled to a heterologous payload.

In some embodiments, carrier is capable of accumulating in the basal compartment of the polarized epithelial cell at least 10 minutes after intraluminal application of the carrier to the gastrointestinal tract of the mammal. In some embodiments, the carrier is capable of accumulating in the basal compartment of polarized epithelial cell at least 15 minutes after intraluminal application of the carrier to the gastrointestinal tract carrier of the mammal.

In some embodiments, the intraluminal application comprises intraluminal injection into a rat jejunum.

In another aspect, the disclosure includes a carrier-payload complex comprising. a carrier derived from a Cholix polypeptide having a C-terminus at any of positions 195-347, coupled to a heterologous payload. In some embodiments, the position numbering is based on alignment of the Cholix polypeptide to the sequence set forth in SEQ ID NO: 130, wherein positions are numbered from an N-terminus to a C-terminus starting with position 1 at the N-terminus.

In some embodiments, the C-terminal truncation is at any one of the positions 195-266 of a sequence set forth in SEQ ID NO: 130. In some embodiments, the C-terminal truncation is at any one of the positions 195-266 of any one of the sequences set forth in SEQ ID NOs: 1-2, or 4-78. In some embodiments, the C-terminal truncation is at any one of positions 206, 245, 251, or 266 a sequence set forth in SEQ ID NO: 130. In some embodiments, the C-terminal truncation is at any one of positions 206, 245, 251, or 266 of SEQ ID NOs: 1-2, or 4-78.

In some embodiments, the C-terminal truncation is at position 206 of any one of SEQ ID NOs: 1-2, or 4-78. In some embodiments, the carrier consists of the amino acid sequence set forth in SEQ ID NOs: 131 or 184. In some embodiments, the C-terminal truncation is at position 245 of any one of SEQ ID NOs: 1-2, or 4-78. In some embodiments, the carrier consists of the amino acid sequence set forth in SEQ ID NOs: 132 or 183. In some embodiments, the C-terminal truncation is at position 251 of SEQ ID NOs: 1-2, or 4-78. In some embodiments, the carrier consists of the amino acid sequence set forth in SEQ ID NOs: 133 or 182. In some embodiments, the C-terminal truncation is at position 266 of SEQ ID NOs: 1-2, or 4-78. In some embodiments, the carrier consists of the amino acid sequence set forth in SEQ ID NOs: 134 or 181. In some embodiments, the carrier consists of the sequence set forth in SEQ ID NOs: 1-2, or 4-78 with truncation at any one of the positions 195-347, and has no more than 5, 4, 3, 2, or 1 amino acid variations at any of positions 1-40, 133-151, 152-187, or 188-206 of SEQ ID NOs: 1-2, or 4-78.

In another aspect, the disclosure includes a carrier-payload complex comprising a carrier derived from a Cholix polypeptide having an N-terminus at positions 1-41 and a C-terminus at positions 150-195, or consisting of the amino acid residues from any one of the N-terminal positions 35-40 to any one of the C-terminal positions 150-205 of the sequence set forth in SEQ ID NO: 130, coupled to a heterologous payload. In some embodiments, the position numbering is based on alignment of the Cholix polypeptide to the sequence set forth in SEQ ID NO: 130, wherein positions are numbered from an N-terminus to a C-terminus starting with position 1 at the N-terminus.

In some embodiments, the carrier is capable of remaining associated with an apical entry receptor following endocytosis of the carrier into a polarized epithelial cell. In some embodiments, the apical entry receptor is a TMEM132 receptor (e.g., TMEM132A).

In some embodiments, the carrier consists of the amino acid residues from the N-terminal position 40 to any one of the C-terminal positions 150-205 of the sequence set forth in SEQ ID NO: 130. In some embodiments, the carrier has a C-terminal truncation at positions 150 or 186 of the sequence set forth in SEQ ID NO: 130.

In some embodiments, the carrier is capable of transporting the payload to a basal compartment or a supranuclear compartment in a polarized epithelial cell. In some embodiments, the carrier consists of the amino acid sequence set forth in SEQ ID NO: 136. In some embodiments, the carrier is capable of transporting the payload to an apical compartment in a polarized epithelial cell.

In some embodiments, the carrier consists of the amino acid sequence set forth in any one of SEQ ID NOs: 137-139.

In another aspect, the disclosure includes a carrier-payload complex comprising a derived from a Cholix polypeptide having an amino acid sequence set forth in any one of SEQ ID NOs: 1-2, 4-125, or 127-129, or a fragment thereof capable of endocytosis into a polarized epithelial cell or transcytosis of a polarized epithelial cell, coupled to a heterologous payload.

In some embodiments, the carrier comprises a glutamic acid at position 3 and an alanine at position 4.

In some embodiments, the carrier is non-toxic.

In some embodiments, the carrier is capable of transcytosing the heterologous payload across a polarized epithelial cell.

In some embodiments, the carrier comprises a fragment capable of transcytosis of a polarized epithelial cell, wherein the carrier has a C-terminal truncation at any one of the positions 195 to a C-terminal residue of the sequence set forth in any one of SEQ ID NOs: 1-2, or 4-78. In some embodiments, the C-terminal truncation is at any one of the positions 195-386 of the sequence set forth in any one of SEQ ID NOs: 1-2, or 4-78. In some embodiments, the C-terminal truncation is at position 386 of any one of the sequences set forth in SEQ ID NOs: 1-2, or 4-78. In some embodiments, the C-terminal truncation is at position 386 of any one of the sequences set forth in SEQ ID NOs: 1-2. In some embodiments, the carrier consists of the amino acid sequence set forth in SEQ ID NO: 135.

In another aspect, the disclosure includes a carrier-payload complex comprising a carrier derived from a Cholix polypeptide that does not comprise SEQ ID NO: 179, and does not consist of SEQ ID NO: 126, complexed with a heterologous payload, wherein the carrier is capable of transcytosing the heterologous payload across a polarized epithelial cell; or transporting the heterologous payload into the polarized epithelial cell.

In some embodiments, the carrier comprises at least 75% sequence identity to a sequence set forth in SEQ ID NO: 130, or fragment thereof. In some embodiments, the carrier comprises at least 90% sequence identity to a Cholix variant set forth in SEQ ID NO: 130, or a fragment thereof. In some embodiments, the Cholix polypeptide is a sequence set forth in SEQ ID NO: 130, or fragment thereof. In some embodiments, the carrier comprises a glutamic acid at position 3 and an alanine at position 4.

In some embodiments, the carrier is non-toxic.

In some embodiments, the carrier is capable of transcytosing the heterologous payload across the polarized epithelial cell.

In some embodiments, the carrier has a C-terminal truncation at any one of the positions 195-633 of the sequence set forth in SEQ ID NO: 130. In some embodiments, the C-terminal truncation is at any one of the positions 195-386 of the sequence set forth in SEQ ID NO: 130. In some embodiments, the carrier has a C-terminal truncation at any one of the positions 195-386 of any one of the sequences set forth in SEQ ID NOs: 1-2, or 4-78. In some embodiments, the C-terminal truncation is at position 386 of any one of the sequences set forth in SEQ ID NOs: 1-2, or 4-78. In some embodiments, the C-terminal truncation is at position 386 of any one of the sequences set forth in SEQ ID NOs: 1-2. In some embodiments, the carrier-payload complex comprises an N-terminal methionine.

In some embodiments, the carrier is synthetically conjugated to the heterologous payload. In some embodiments, the carrier is genetically fused to the heterologous payload.

In some embodiments, the heterologous payload is a therapeutic payload. In some embodiments, the therapeutic payload is a cytokine, an antibody, a hormone, or a nucleic acid. In some embodiments, the therapeutic payload is a cytokine. In some embodiments, the cytokine is an interleukin.

In some embodiments, the interleukin is an IL-10. In some embodiments, the IL-10 comprises an amino acid sequence having at least 90% sequence identity to the amino acid sequence set forth in SEQ ID NO: 145. In some embodiments, the interleukin is an IL-22. In some embodiments, the IL-22 comprises an amino acid sequence having at least 90% sequence identity to the amino acid sequence set forth in SEQ ID NO: 142.

In some embodiments, the therapeutic payload is an antibody. In some embodiments, the antibody is an anti-TNF antibody. In some embodiments, the therapeutic payload is a hormone. In some embodiments, the therapeutic payload is a human growth hormone.

In some embodiments, the heterologous payload is covalently coupled to the carrier. In some embodiments, the heterologous payload is coupled to a C-terminus of the carrier. In some embodiments, the heterologous payload is coupled to an N-terminus of the carrier. In some embodiments, the carrier is coupled to the heterologous payload via a spacer.

In some embodiments, the spacer is a non-cleavable spacer. In some embodiments, the spacer comprises between 1 and 100 amino acid residues. In some embodiments, the spacer comprises up to 15 repeats of GS (SEQ ID NO: 169), GGS (SEQ ID NO: 170), GGGS (SEQ ID NO: 171), GGGGS (SEQ ID NO: 172), GGGGGS (SEQ ID NO: 173), or a combination thereof. In some embodiments, the spacer comprises an amino acid sequence set forth in SEQ ID NO: 175. In some embodiments, the spacer consists of the amino acid sequence set forth in SEQ ID NO: 176.

In some embodiments, the heterologous payload is non-covalently coupled to the carrier. In some embodiments, the heterologous payload is complexed to the carrier via a nanoparticle.

In one aspect, the present disclosure includes a polynucleotide encoding any of the carrier-payload complexes (e.g., delivery constructs) described herein, e.g., those comprising, consisting essentially of, or consisting of any one of the amino acid sequences set forth in SEQ ID NOs: 147-150, 152-159 or 188.

In one aspect, the present disclosure includes a vector comprising any of such polynucleotides that encode a carrier-payload complex (e.g., delivery construct) of this disclosure.

In one aspect, the present disclosure includes a method of transcytosing a heterologous payload across a polarized epithelial cell, comprising: (a) contacting an apical membrane of the polarized epithelial cell with a carrier-payload complex; and (b) transcytosing the carrier-payload complex across the polarized epithelial cell, wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the polarized epithelial cell, coupled to the heterologous payload. In some embodiments, contacting the apical membrane of the polarized epithelial cell with the carrier-payload complex comprises interacting of the carrier with the apical entry receptor TMEM132. In some embodiments, interacting of the carrier with the membrane protein TMEM132 results in receptor-mediated endocytosis of the carrier-payload complex. In some embodiments, the carrier that interacts with TMEM132 comprises the amino acid residues 135-151 of SEQ ID NO: 130, or a sequence having at least 90% sequence identity thereto. In some embodiments, the transcytosing of the carrier-payload complex across the polarized epithelial cell comprises interacting of the carrier with any one or more of GRP75 (e.g., GRP75B), ERGIC-53, and perlecan. In some embodiments, the transcytosing of the carrier-payload complex across the polarized epithelial cell further comprises co-localization of the carrier-payload complex with any one or more of COPI, EEA1, and Rab7 at the apical side, and with Rab11a at the basal side of the epithelial cell. In some embodiments, the carrier that interacts with GRP7 or ERGIC-53 comprises the amino acid residues 1-40 and 152-187 of SEQ ID NO: 130, or a sequence having at least 90% sequence identity thereto. In some embodiments, the carrier that interacts with perlecan comprises the amino acid residues 188-205 of SEQ ID NO: 130, or a sequence having at least 90% sequence identity thereto. In some embodiments, the method further comprises, subsequent to (b) delivering the carrier-payload complex into the lamina propria. In some embodiments, the polarized epithelial cell is a polarized gut epithelial cell.

In one aspect, the present disclosure includes a method of orally delivering a heterologous payload to a subject, comprising: orally administering a carrier-payload complex to the subject, wherein the carrier is capable of transcytosing the carrier-payload complex across a polarized epithelium, thereby delivering the heterologous payload to the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the polarized epithelium, coupled to the heterologous payload.

In one aspect, the present disclosure includes a carrier-payload complex for orally delivering a heterologous payload to a subject by a method comprising: orally administering the carrier-payload complex to the subject, wherein the carrier is capable of transcytosing the carrier-payload complex across a polarized epithelium, thereby treating a disease the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the polarized epithelium, coupled to the heterologous payload.

In one aspect, the present disclosure includes a use of a carrier-payload complex for orally delivering a heterologous payload to a subject by a method comprising: orally administering the carrier-payload complex to the subject; wherein the carrier is capable of transcytosing the carrier-payload complex across a polarized epithelium, thereby treating a disease in the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the polarized epithelium, coupled to the heterologous payload.

In one aspect, the present disclosure includes a method of treating a disease in a subject, comprising: orally administering a carrier-payload complex to the subject, wherein the carrier is capable of transcytosing the carrier-payload complex across a polarized epithelium, thereby treating a disease in the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the polarized epithelium, coupled to the heterologous payload.

In one aspect, the present disclosure includes a carrier-payload complex for use in treating a disease in a subject by a method comprising: orally administering the carrier-payload complex to the subject, wherein the carrier is capable of transcytosing the carrier-payload complex across a polarized epithelium, thereby treating the disease in the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the polarized epithelium, coupled to the heterologous payload.

In one aspect, the present disclosure includes a use of a carrier-payload complex in the manufacture of a medicament for treating a disease in a subject by a method comprising: orally administering the carrier-payload complex to the subject, wherein the carrier is capable of transcytosing the carrier-payload complex across a polarized epithelium, thereby treating the disease in the subject, and wherein the carrier-payload complex comprises a carrier derived from a Cholix polypeptide having an amino acid sequence set forth in any one of SEQ ID NOs: 1-2, 4-125, or 127-129, or a fragment thereof capable of transcytosing the carrier-payload complex across the polarized epithelium, coupled to the heterologous payload. In some embodiments, the method further comprises binding of the heterologous payload to a receptor in the lamina propria. In some embodiments, the method further comprises delivering the heterologous payload into systemic circulation. In some embodiments, the carrier is a Cholix derived polypeptide. In some embodiments, the carrier comprises amino acid residues 1-206, 1-245, 1-251, 1-266, or 1-386 of a sequence set forth in SEQ ID NO: 130. In some embodiments, the carrier comprises amino acid residues 1-206, 1-245, 1-251, 1-266, or 1-386 of the sequence set forth in any one of SEQ ID NOs: 1-2. In some embodiments, the carrier comprises any one of the amino acid sequences set forth in SEQ ID NOs: 131-135 or 180-184. In some embodiments, the polarized epithelium is a polarized gut epithelium. In some embodiments, the disease is ulcerative colitis, pouchitis, proctitis, Crohn's disease, Multiple sclerosis (MS), Systemic lupus erythematosus (SLE), Graft versus host disease (GVHD), Rheumatoid arthritis, or Psoriasis. In some embodiments, the disease is ulcerative colitis. In some embodiments, the ulcerative colitis is mild-to-moderate or moderate to severe. In some embodiments, the disease is Crohn's disease. In some embodiments, the Crohn's disease is Fistulizing Crohn's disease. In some embodiments, the payload is an interleukin. In some embodiments, the interleukin comprises the amino acid sequence of SEQ ID NOs: 142 or 145.

In one aspect, the present disclosure includes a method of transporting a heterologous payload into a polarized epithelial cell, comprising: (a) contacting the apical membrane of the polarized epithelial cell with a carrier-payload complex; and (b) transporting the carrier-payload complex into the polarized epithelial cell, wherein the carrier-payload complex comprises a carrier derived from a Cholix polypeptide having an amino acid sequence set forth in any one of SEQ ID NOs: 1-2, 4-125, or 127-129, or a fragment thereof capable of transporting the carrier-payload complex into the epithelial cell, coupled to the heterologous payload. In some embodiments, contacting the apical membrane of the polarized epithelial cell with the carrier-payload complex comprises interacting of the carrier with the apical entry receptor TMEM132. In some embodiments, interacting of the carrier with the apical entry receptor TMEM132 results in receptor-mediated endocytosis of the carrier-payload complex. In some embodiments, the method further comprises transporting the heterologous payload to an apical compartment or a basal compartment. In some embodiments, the carrier of the carrier-payload complex remains associated with TMEM132 after endocytosis. In some embodiments, the carrier that interacts with TMEM132 comprises amino acid residues 135-151 of SEQ ID NO: 130, or a sequence having at least 90% sequence identity thereto. In some embodiments, the carrier is a Cholix derived polypeptide. In some embodiments, the carrier consists of amino acid residues 1-151, 1-187, 41-187, or 40-205 of a sequence set forth in SEQ ID NO: 130. In some embodiments, the carrier consists of amino acid residues 1-151, 1-187, 41-187, or 40-205 of the sequence set forth in SEQ ID NOs: 1-2. In some embodiments, the carrier consists of any one of the amino acid sequences set forth in SEQ ID NOs: 136-139. In some embodiments, the carrier is non-covalently coupled to the heterologous payload via a nanoparticle. In some embodiments, a ratio of the heterologous payload to the carrier on the nanoparticle is at least 15,000:1. In some embodiments, the heterologous payload is a glucose-lowering agent. In some embodiments, the glucose-lowering agent is non-covalently associated with the nanoparticle. In some embodiments, the heterologous payload is an siRNA. In some embodiments, the siRNA is non-covalently associated with the nanoparticle. In some embodiments, the carrier is covalently-linked to the nanoparticle or is spray-dried on the nanoparticle.

BRIEF DESCRIPTION OF THE DRAWINGS

Various features of the present disclosure are set forth with particularity in the appended claims. A better understanding of the features and advantages of the present disclosure will be obtained by reference to the following detailed description that sets forth illustrative aspects, in which the principles of the disclosure are utilized, and the accompanying drawings (also "Figure" and "FIG." herein), of which:

FIG. 1 schematically shows a setup comprising an apical chamber above an epithelial cell monolayer and a basal chamber below such epithelial cell monolayer. For apical to basolateral permeability (e.g., transcytosis), test articles (e.g., carriers, delivery constructs, payloads, etc.) were applied to the apical (A) side and the amount of permeated (e.g., transcytosed) material was determined (e.g., using western blotting, chromatography, etc.) on the basolateral (B) side.

FIG. 2 shows that a delivery construct with SEQ ID NO: 147, comprising a carrier (SEQ ID NO: 134) and an IL-22 payload (SEQ ID NO: 142), transported the IL-22 payload across intact, polarized, Caco-2 gut epithelial cell monolayers in a time-dependent manner (the amount of protein on the basolateral site was measured 15, 30, and 45 minutes after the delivery construct was applied to the apical membrane of the monolayer as described above in FIG. 1). The data further show that when the delivery construct (SEQ ID NO: 147) comprising the carrier of SEQ ID NO: 134 and the IL-22 payload of SEQ ID NO: 142 is applied to the Caco-2 epithelial cells, about 2-3 fold more IL-22 crossed the Caco-2 epithelial cell monolayer as compared to when an IL-22 (SEQ ID NO: 143) not coupled to a carrier is applied to the Caco-2 epithelial cells.

FIG. 3 shows that a delivery construct with SEQ ID NO: 147, comprising a carrier (SEQ ID NO: 134) and an IL-22 payload (SEQ ID NO: 142), resulted in the IL-22 payload being transported across intact and polarized SMI-100 gut epithelial cell monolayers in a time-dependent manner (the amount of protein in the basolateral chamber was measure at 15, 30, and 45 minutes after the delivery construct was applied to the apical membrane of the monolayer). The data further shows that when the delivery construct including the carrier of SEQ ID NO: 134 coupled to the IL-22 payload of SEQ ID NO: 142 is applied to the SMI-100 epithelial cells, about 2-3 fold more IL-22 crossed the SMI-100 epithelial cell monolayer as compared to when an IL-22 (SEQ ID NO: 143) not coupled to a carrier is applied to the SMI-100 epithelial cells.

FIG. 4 demonstrates that a delivery construct with SEQ ID NO: 147 results in IL-22 (SEQ ID NO: 142) being transported in significant amounts across an intact and polarized gut epithelium in vivo. Apical site of the gut epithelium is highlighted by white arrow #1. The lamina propria is abbreviated as "l.p." The outer basal membrane of the polarized epithelium is highlighted by white arrows #2. IL-22 localization is indicated by white arrows and green fluorescence (e.g., white arrows #3), blue fluorescence indicates DAPI staining.

FIG. 5 shows that a first delivery construct (SEQ ID NO: 147), and a second delivery construct (SEQ ID NO: 148) transported an IL-22 payload across Caco-2 monolayers ("after transport" refers to protein located in the basolateral compartment after transport across Caco-2 monolayers). The western blot data further shows that the delivery constructs were intact after transport, e.g., as shown by the absence of lower molecular weight degradation products. Transport of the IL-22 payload with delivery constructs SEQ ID NO: 147 and SEQ ID NO: 148 are shown relative to transport of an IL-22 control protein (SEQ ID NO: 143) in the absence of a carrier. The control protein IL-22 consisted of the amino acid sequence set forth in SEQ ID NO: 143.

FIG. 6 shows the amount of a delivery construct (SEQ ID NO: 147) and an IL-22 (SEQ ID NO: 143) detected in the basolateral compartment of Caco-2 epithelial cell monolayers following transcytosis. Protein amounts were normalized. The data show that transport of a delivery construct (SEQ ID NO: 147) including a Cholix-derived carrier (SEQ ID NO: 134) across polarized epithelial cells was dependent on glucose-regulated protein 75 (GRP75, e.g., GRP75B). Caco-2 cells with knockdown of GRP75 (indicated as Caco-$2^{GRP75-}$) showed significantly reduced transport of the delivery construct (SEQ ID NO: 147) as compared to cells expressing GRP75 (indicated as Caco-2). Dependence of transport on GRP75 is indicated by the reduced amount of delivery construct that was detected in the basolateral compartments in GRP75 knockdown cells as compared to cells expressing GRP75. The transport of IL-22 (SEQ ID NO: 143) alone was not affected by GRP75 knockdown.

FIG. 7 shows that transport of a delivery construct (SEQ ID NO: 147) across polarized epithelial cells was dependent on basement membrane-specific heparan sulfate proteoglycan core protein (HSPG). Caco-2 cells with knockdown of this protein (indicated as Caco-$2^{HSPG-}$) showed significantly reduced transport of the delivery construct (SEQ ID NO: 147) compared to cells expressing HSPG (indicated as Caco-2). Dependence of transport on HSPG is indicated by the reduced amount of delivery construct that was detected in the basolateral compartments in HSPG knockdown cells as compared to cells expressing HSPG. Transport of IL-22 (SEQ ID NO: 143) alone (i.e., not coupled to a carrier) was not dependent on HSPG.

FIG. 8 depicts fluorescence microscopic detection of a delivery construct (SEQ ID NO: 154) in apical compartments (highlighted with white arrow #2) within epithelial cells 15 min after intra-luminal injection using a rat intra-luminal injection model (white arrow #1 highlights the apical surface, white arrow #3 highlights the basal membrane, and white arrow #4 highlights the lamina propria). The data demonstrate that a carrier derived from an example of Cholix$^{41-187}$ (e.g., SEQ ID NO: 137) was capable of transporting a payload to apical compartments of epithelial cells, but not across epithelial cells. Red fluorescence shows localization of a Cholix carrier, green fluorescence shows localization of hGH (SEQ ID NO: 146), and blue fluorescence indicates DAPI staining.

FIG. 9 depicts fluorescence microscopic detection of a delivery construct (SEQ ID NO: 156) in apical compartments (highlighted with white arrow #2) of epithelial cells 15 min after intra-luminal injection using a rat intra-luminal injection model (white arrow #1 highlights the apical surface, white arrow #3 highlights the basal membrane, and white arrow #4 highlights the lamina propria). The data demonstrate that a carrier derived from an example of Cholix$^{40-205}$ (SEQ ID NO: 138) was capable of transporting a payload (e.g., hGH) to apical compartments of epithelial cells, but not across epithelial cells into the lamina propria. These data further suggest that residues 1-39 of SEQ ID NO: 1 can play a role in transcytosis but may not be required for endocytosis of a Cholix carrier. Red fluorescence shows localization of a Cholix carrier, green fluorescence shows localization of hGH (SEQ ID NO: 146), and blue fluorescence indicates DAPI staining.

FIG. 10A depicts fluorescence microscopic detection of a delivery construct (SEQ ID NO: 153) in apical compartments inside epithelial cells 5 min after intra-luminal injection of the delivery construct to rat jejunum. In FIGS. 10A-10C, red fluorescence shows localization of a Cholix carrier, green fluorescence shows localization of hGH (SEQ ID NO: 146), and blue fluorescence indicates DAPI staining; white arrow #1 highlights the apical compartments, and white arrow #2 highlights supranuclear compartments.

Figure 11A:
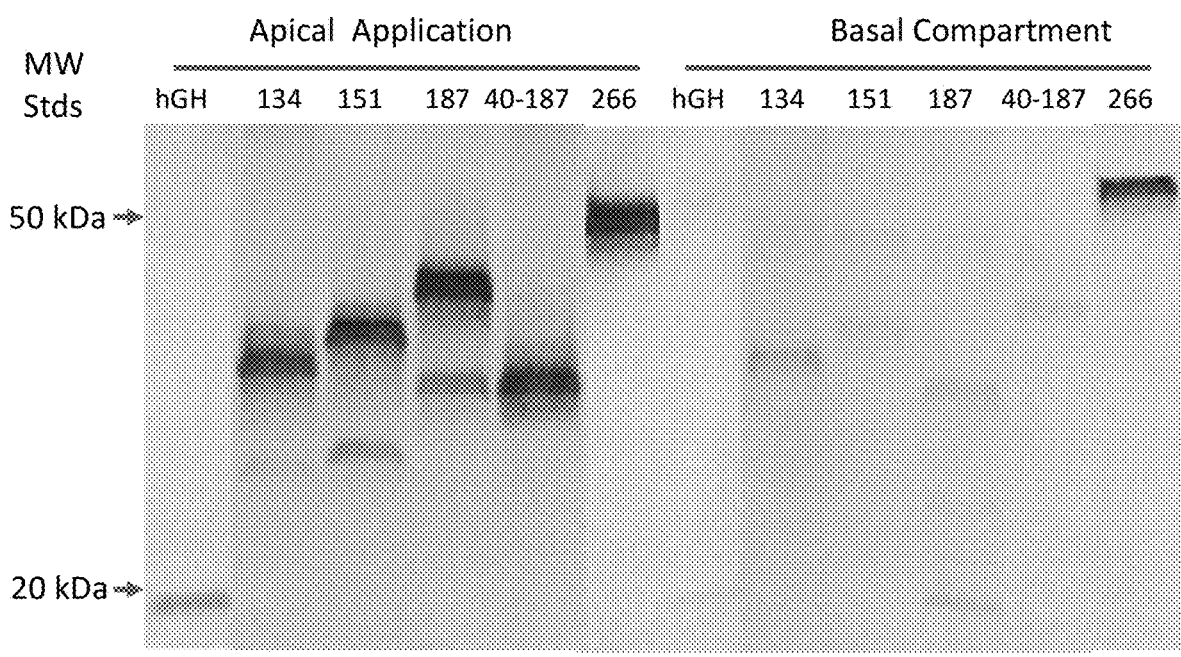
Figure 11B:
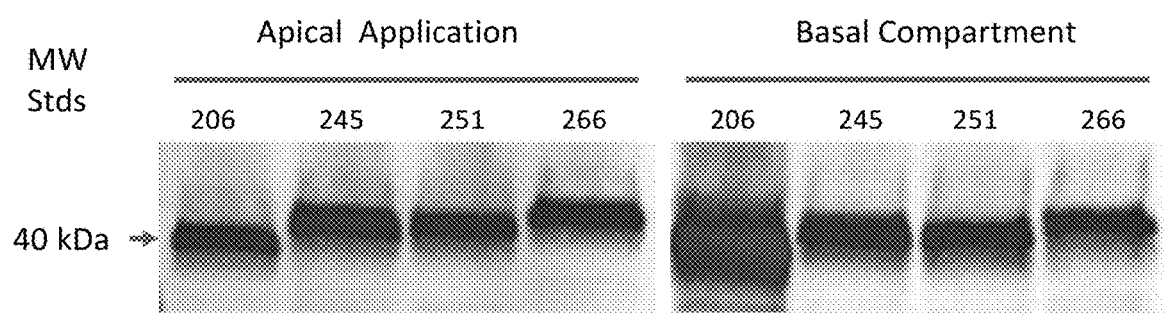

FIGS. 11A-11B depict apical-to-basal transport of human growth hormone (hGH, SEQ ID NO: 190) alone compared to hGH (SEQ ID NO: 146) coupled to carriers. The carrier lengths are indicated by the C-terminal truncation relative to reference SEQ ID NO: 1 (e.g., "134" indicates a carrier having the residues 1-134 of SEQ ID NO: 1). All carriers further included an N-terminal methionine). Western blotting for hGH qualitatively assessed the capacity of these proteins to undergo apical-to-basal transport across polarized monolayers of primary human small intestinal epithelial cells in vitro after 2 h. The amounts of apically-applied materials were equivalent on a molar basis for hGH content, and basal collections were concentrated ~10-fold prior to analysis.

FIG. 11A shows a comparison of the apical-to-basal transport of hGH (SEQ ID NO: 190) alone relative to that measured for the delivery constructs with the sequence set forth in SEQ ID NO: 151-SEQ ID NO: 154 and SEQ ID NO: 159 with truncations at positions 134, 151, 187, 41-187, and 266, respectively. The data demonstrates that Cholix carriers with C-terminal truncations at positions 134, 151, 187 of SEQ ID NO: 1, or an N-terminal truncation at 41 and a C-terminal truncation at 187 of SEQ ID NO: 1, showed significantly lower apical-to-basal transport of conjoined hGH as compared to the construct with a Cholix carrier (SEQ ID NO: 159) with a C-terminal truncation at 266.

FIG. 11B shows that the delivery constructs with SEQ ID NO: 155 and SEQ ID NO: 157-SEQ ID NO: 159 and that include Cholix carriers with C-terminal truncations at positions 206 (SEQ ID NO: 131), 245 (SEQ ID NO: 132), 251 (SEQ ID NO: 133), and 266 (SEQ ID NO: 134), respectively, compared to SEQ ID NO: 1 demonstrated efficient apical-to-basal transport of conjoined hGH (SEQ ID NO: 146). While carriers with Cholix C-terminal truncations at positions 245 and 251 demonstrated apical-to-basal transport of conjoined hGH (SEQ ID NO: 146) comparable to that of the carrier with the C-terminal truncation at position 266, the carrier with a Cholix C-terminal truncation at position 206 showed a significant enhancement of apical-to-basal transport of hGH compared to the carriers with C-terminal truncations at positions 245, 251, and 266.

FIGS. 12A-12F show the extent of apical to basal transport across polarized gut epithelial cells in rat jejunum of six delivery constructs, each including a different Cholix carrier. Localization of the Cholix carrier (red fluorescence) and hGH (green fluorescence) is demonstrated by immunofluorescence microscopy using polyclonal anti-Cholix and monoclonal anti-hGH antibodies, respectively. White arrows indicate the apical membrane, "l-p" refers to lamina propria, "GC" refers to goblet cells, and open arrows indicates delivery construct present in the lamina propria.

Figure 12A:
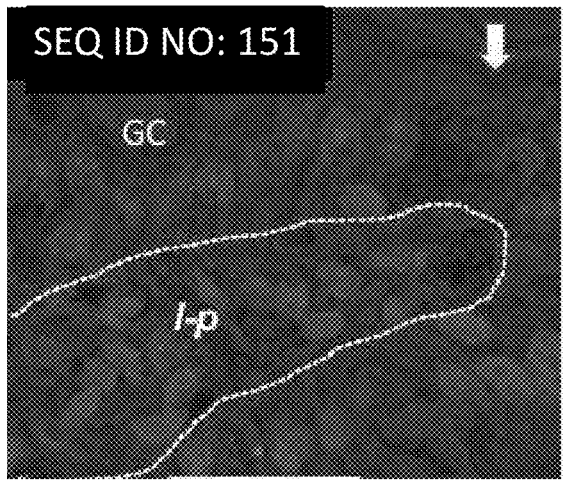

FIG. 12A shows the extent of apical to basal transport 15 min after intraluminal injection of a delivery construct (SEQ ID NO: 151) including a Cholix carrier (SEQ ID NO: 140) coupled to hGH (SEQ ID NO: 146). FIG. 12A shows that the carrier did not enable the delivery construct to enter epithelial cells, suggesting that a functional sequence fragment having amino acid residues 135-151 of SEQ ID NO: 1 can play a role in endocytosis into polarized epithelial cells (in contrast, FIG. 12B demonstrates that the carrier with SEQ ID NO: 139 enabled cellular entry of the respective delivery construct via endocytosis).

Figure 12B:
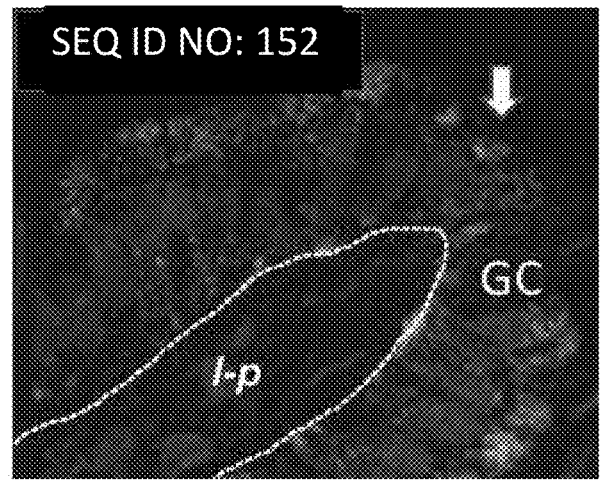

FIG. 12B shows the extent of apical to basal transport 15 min after intraluminal injection of a delivery construct (SEQ ID NO: 152) including a Cholix carrier (SEQ ID NO: 139) coupled to hGH (SEQ ID NO: 146) as demonstrated by immunofluorescence microscopy. FIG. 12B shows that this construct did enter epithelial cells (as opposed to the construct with SEQ ID NO: 151 described in FIG. 12A) but mainly remained in apical and, to some extent, in basal vesicular pools but did not enter the lamina propria, thereby enabling delivery of payload to apical and basal compartments of an epithelial cell.

Figure 12C:
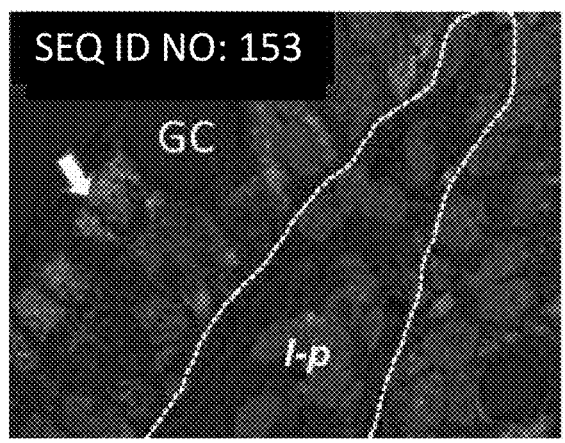

FIG. 12C shows the extent of apical to basal transport 15 min after intraluminal injection of a delivery construct (SEQ ID NO: 153) including a Cholix carrier (SEQ ID NO: 136) coupled to hGH (SEQ ID NO: 146) as demonstrated by immunofluorescence microscopy. FIG. 12C shows that this construct entered epithelial cells, reached apical and basal compartments and also reached a supra-nuclear region of the cell, yet still remained inside the epithelial cell, suggesting that the sequence fragment consisting of amino acid residues 152-187 of SEQ ID NO: 1 can allow access and delivery to supranuclear regions, as well as allow localization in basal compartments.

Figure 12D:
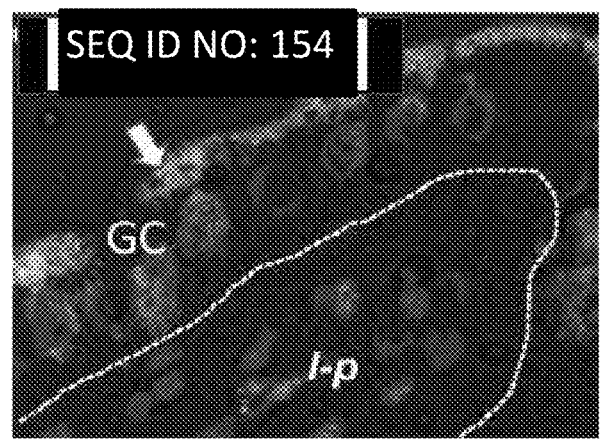

FIG. 12D shows the extent of apical to basal transport 15 min after intraluminal injection of a delivery construct (SEQ ID NO: 154) including a Cholix carrier (SEQ ID NO: 137) coupled to hGH (SEQ ID NO: 146) as demonstrated by immunofluorescence microscopy. FIG. 12D shows that this construct entered epithelial cells but remained in apical compartments and did not appear to reach basal or supra-nuclear compartments.

Figure 12E:
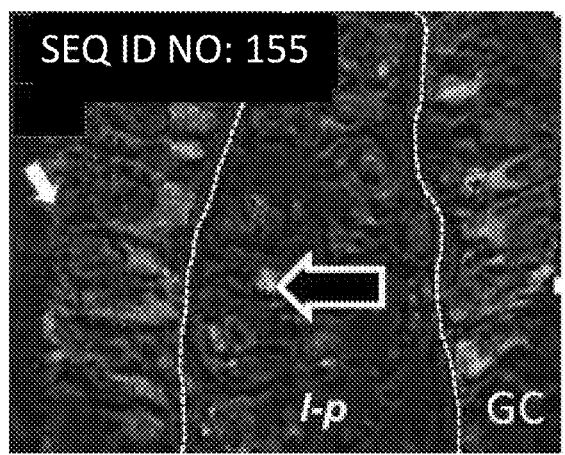

FIG. 12E shows the extent of apical to basal transport 15 min after intraluminal injection of a delivery construct (SEQ ID NO: 155) including a Cholix carrier (SEQ ID NO: 131) coupled to hGH (SEQ ID NO: 146) as demonstrated by immunofluorescence microscopy. FIG. 12E shows that this construct completed the transcytosis process as indicated by delivery constructs reaching the lamina propria (see open arrow), suggesting that the sequence fragment consisting of amino acid residues 188-206 of the sequence set forth in SEQ ID NO: 1 can enable the carrier (and constructs comprising such carrier) to engage with basal recycling processes that allow release of the carrier or respective construct from the epithelial cell into a basolateral compartment (e.g., lamina propria).

Figure 12F:
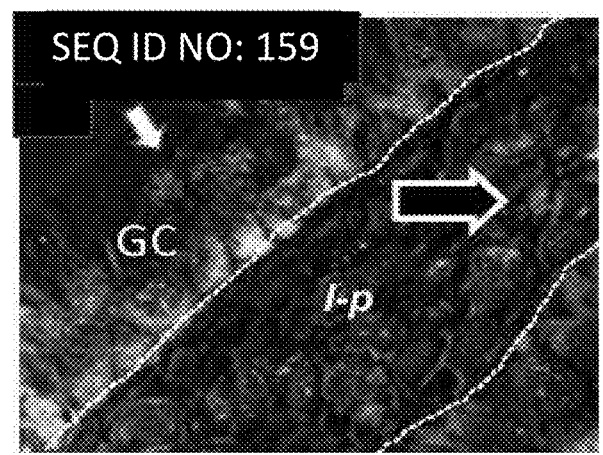

FIG. 12F shows the transport across rat jejunum epithelial monolayers in vivo 15 min after intraluminal injection of a delivery construct (SEQ ID NO: 159) including a Cholix carrier (SEQ ID NO: 134) coupled to hGH (SEQ ID NO: 146) as demonstrated by immunofluorescence microscopy. FIG. 12F shows that this construct completed the transcytosis process as indicated by delivery constructs reaching the lamina propria (see open arrow).

Figure 13A:
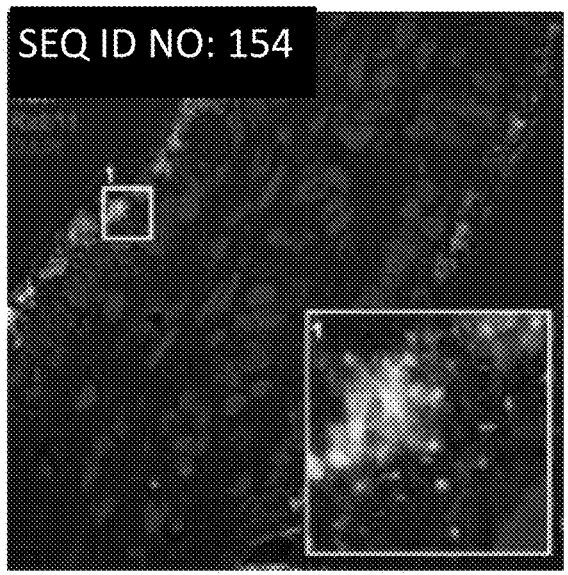
Figure 13B:
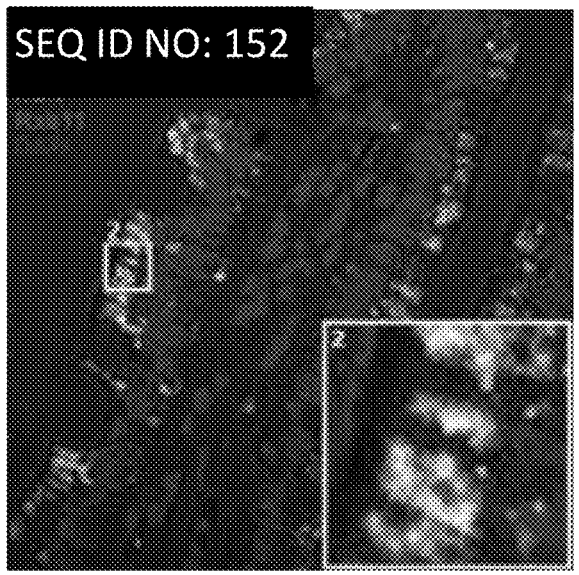
Figure 13C:
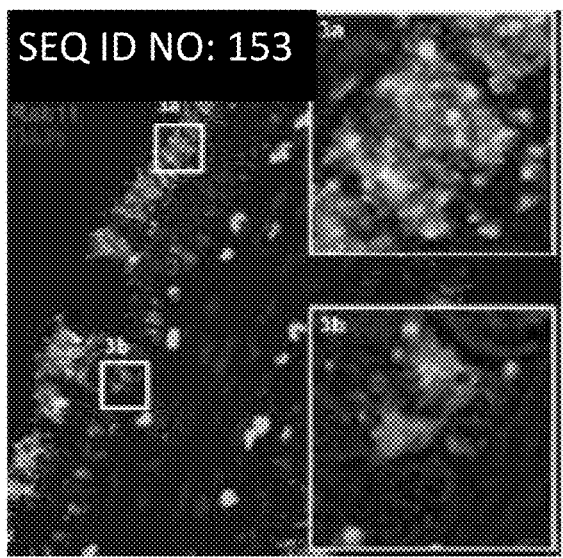

FIG. 13A, FIG. 13B, and FIG. 13C show that the delivery constructs with SEQ ID NO: 154, SEQ ID NO: 152, and SEQ ID NO: 153, respectively, co-localized with Rab11a on the apical side of the epithelial cells. The data also show that the constructs with SEQ ID NO: 152 and SEQ ID NO: 154 did not significantly localize at the basal side but remained mainly at the apical side. The construct with SEQ ID NO: 153 did localize at both the apical and basal side, however only co-localized with Rab11a at the apical side and not at the basal side (sub-images 3a and 3b of FIG. 13C). Together, these results suggest that carriers that are not capable of transcytosis can enter apical recycling systems of the epithelial cell. Measurements were carried out 15 min after intraluminal injection. Green fluorescence shows localization of hGH, red fluorescence shows localization of Rab11a (or Rab11), and blue fluorescence indicates DAPI staining (experimental description includes FIG. 13D).

Figure 13D:
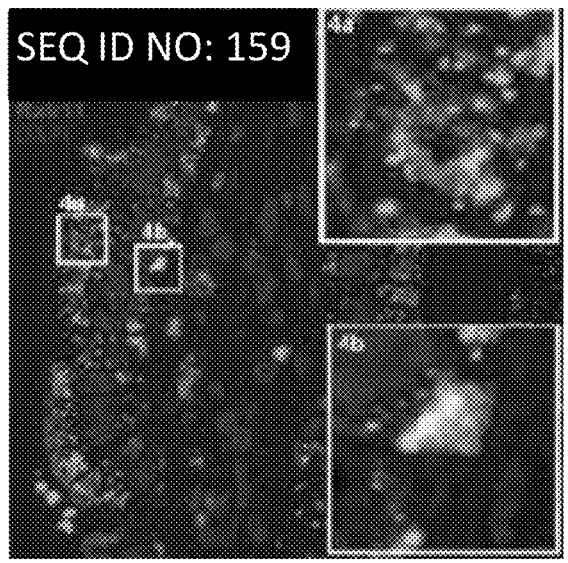

FIG. 13D shows that the delivery construct with SEQ ID NO: 159 co-localized with Rab11a on the basal side but not significantly on the apical side of the polarized epithelial cell. This suggests that carriers capable of transcytosis can utilize the basal recycling system for their release from the epithelial cell into the lamina propria (see sub-images 4a and 4b of FIG. 13D).

Figure 14A:
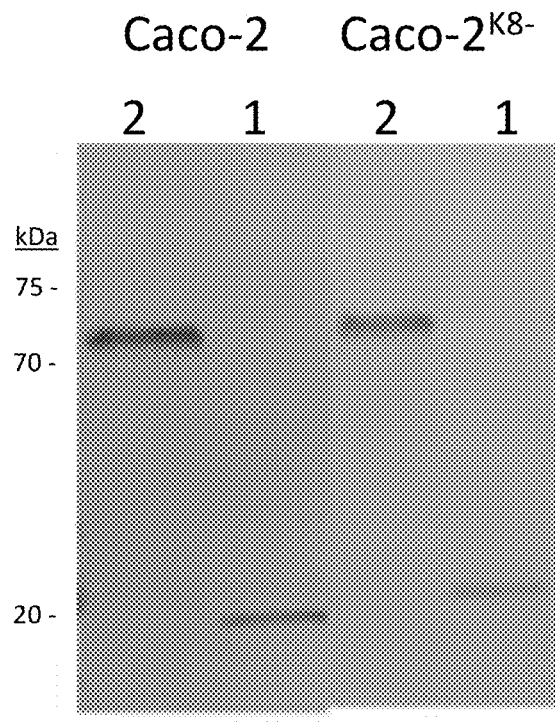
Figure 14B:
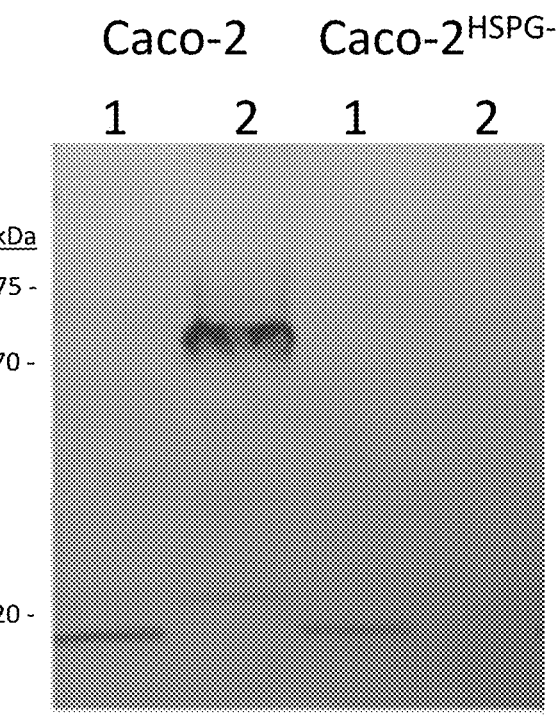
Figure 14C:
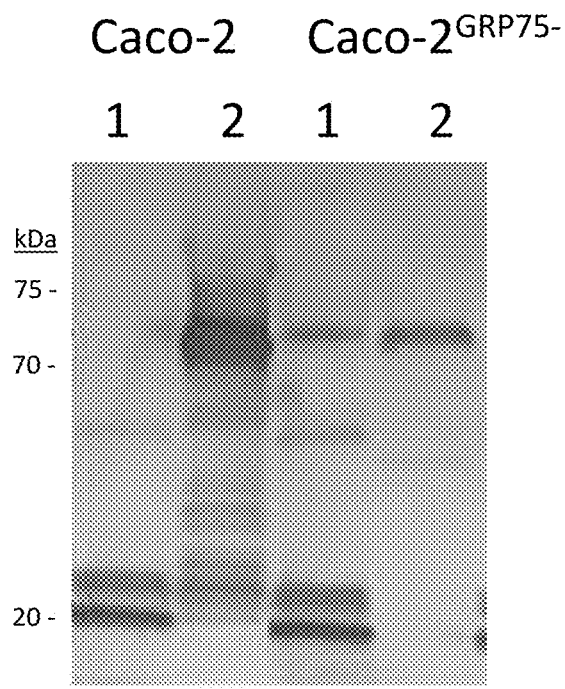

FIGS. 14A-14C show knockout effects of K8, HSPG (perlecan), and GRP75, respectively, on the transcytosis function of a delivery construct with SEQ ID NO: 150 that includes a Cholix derived carrier with the sequence set forth in SEQ ID NO: 134 coupled to hGH via a spacer which sequence is set forth in SEQ ID NO: 177, as compared to hGH alone (SEQ ID NO: 190). Stable cell lines of Caco-2 cells lacking the expression of specific candidate proteins K8 (Caco-2$^{K8-}$), HSPG (Caco-2$^{HSPG-}$), and GRP75 (Caco-2$^{GRP75-}$) were used as monolayers in vitro to verify their involvement in carrier (e.g., Cholix carriers) transcytosis via active and selective endogenous transport mechanisms.

FIG. 14A shows that K8 knockout did not significantly reduce transcytosis function of the delivery construct (SEQ ID NO: 150).

FIG. 14B shows that HSPG (perlecan) knockout did significantly reduce transcytosis function of the delivery construct (SEQ ID NO: 150).

FIG. 14C shows that GRP75 knockout did significantly reduce transcytosis function of the delivery construct (SEQ ID NO: 150).

Figure 15A:
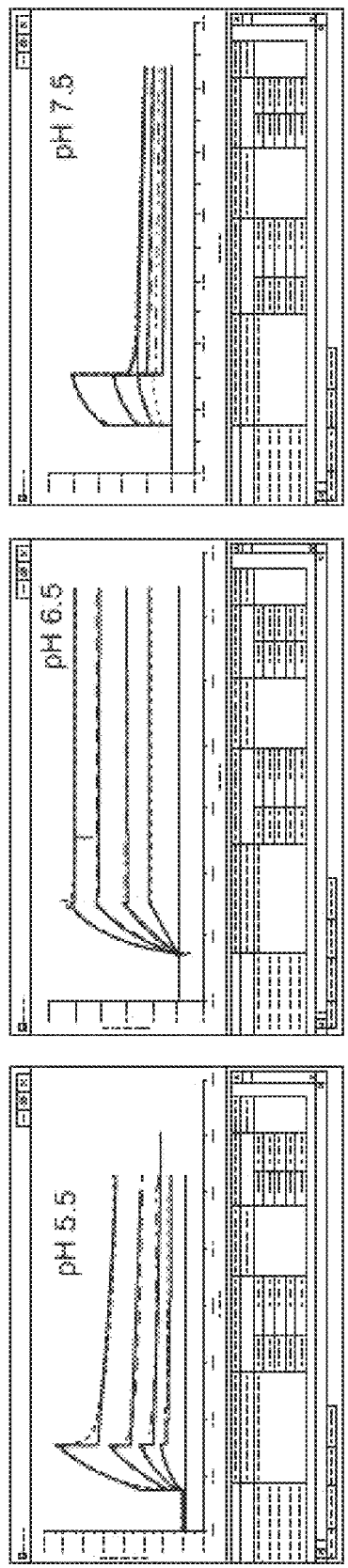

FIG. 15A shows Biacore™ binding interactions used to examine the pH-dependency of Cholix carrier-GRP75 interactions. To that end, biotin was coupled to the C-terminus of full-length Cholix protein which sequence is set forth in SEQ ID NO: 1 and subsequently attached to a surface (e.g., chip surface, plastic 96-well plate, etc.) using the biotin-streptavidin bioconjugation and incubated with purified GRP75 protein in buffer solutions at pH 5.5, 6.5, and 7.5, respectively. Highest binding affinity was for this interaction was measured at pH 6.5.

Figure 15B:
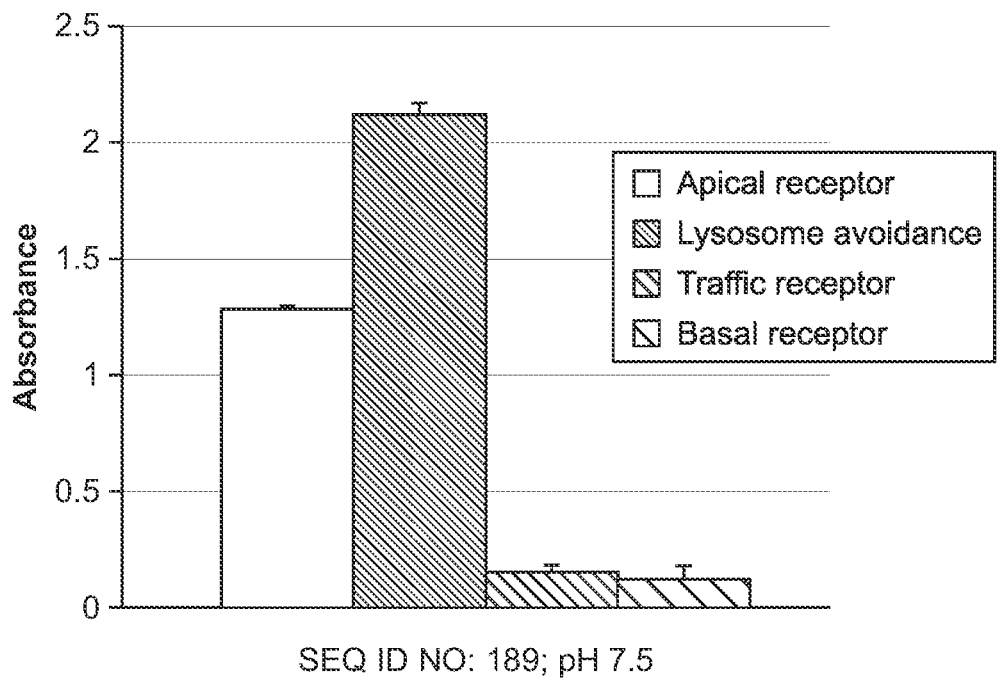
Figure 15B:
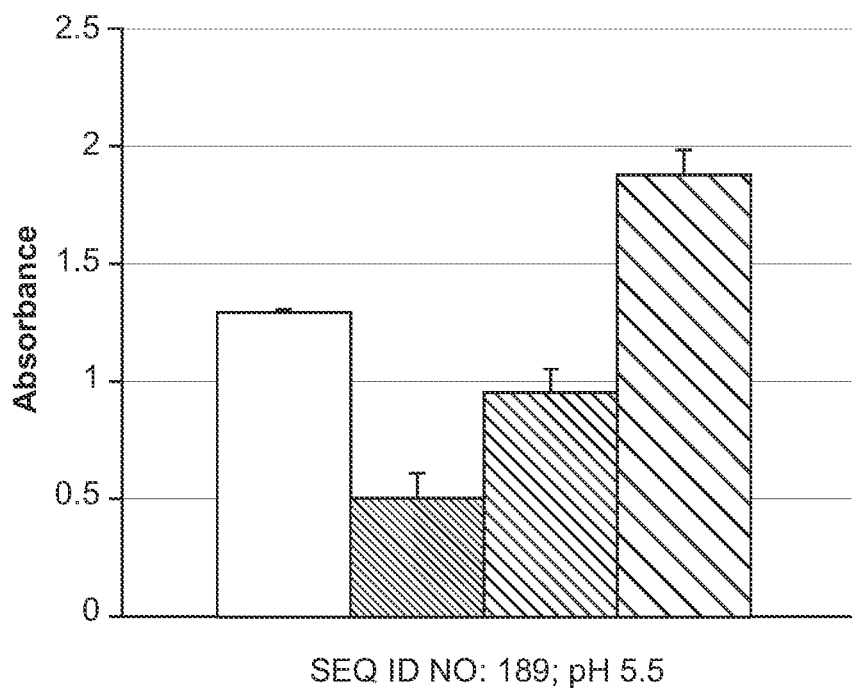

FIG. 15B shows the pH-dependence of the interaction of a Cholix-derived carrier (SEQ ID NO: 189, full-length Cholix sequence of SEQ ID NO: 1 with a deletion of the glutamic acid residue at position 581) with the apical receptor (e.g., TMEM132 such as TMEM132A), the lysosome avoidance receptors (e.g., GRP75), traffic receptor (e.g., ERGIC-53), and basal receptor (e.g., perlecan). This pH dependency of receptor interaction as determined in plasmon resonance assays indicates that a Cholix-derived carrier can interact with certain receptors sequentially dependent on its location. For example, these data show that a Cholix-derived carrier has a significantly higher affinity to endocytosis and early trafficking receptors such as apical entry receptor and lysosome avoidance receptor at pH 7.5. Once the pH drops to about 5.5, the affinity of the Cholix carrier for these early trafficking receptors decreases, while its affinity for the apical-basal trafficking receptor ERGIC-53 and the basal release protein perlecan significantly increases at that pH, allowing the Cholix carrier to "be handed off" to trafficking and basal release receptors during the vesicular transcytosis process.

Figure 16:
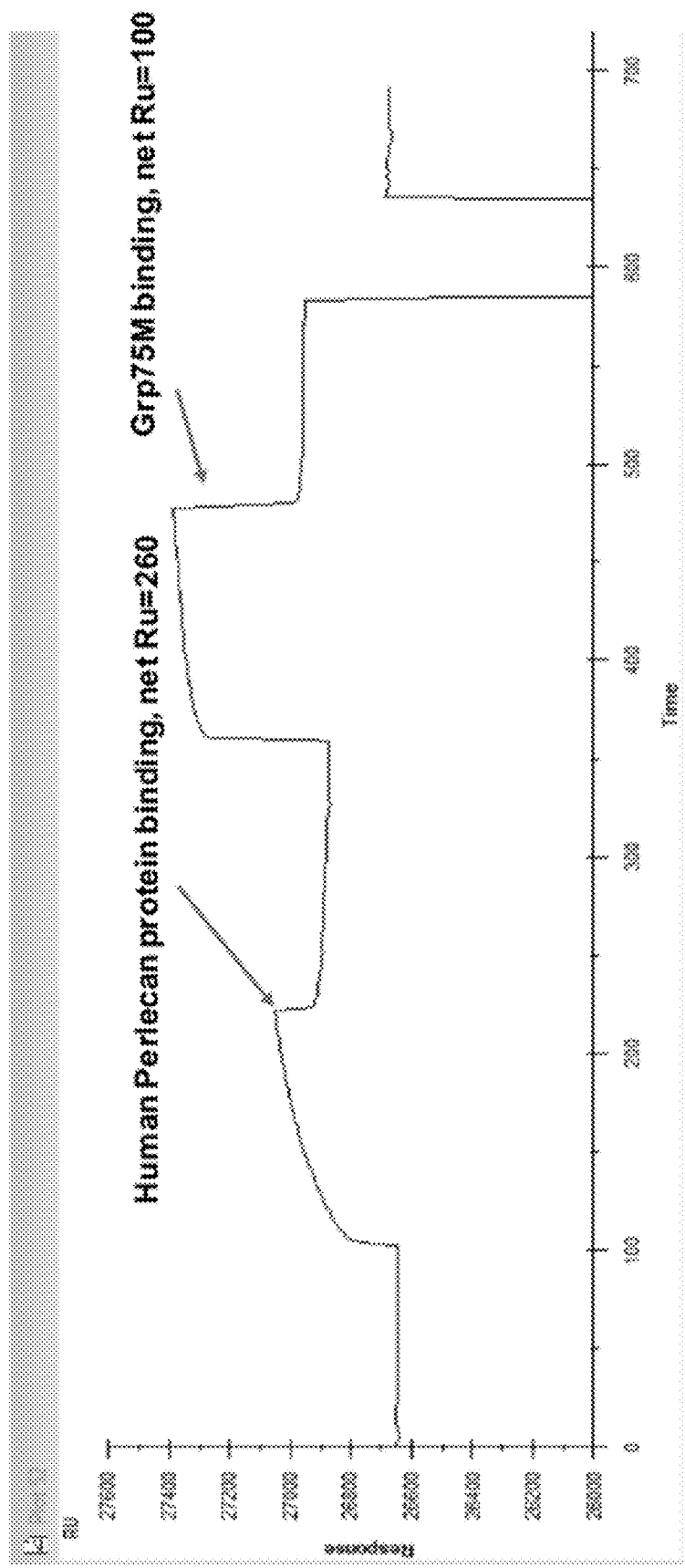

FIG. 16 shows significant Biacore™ binding interactions of the full-length Cholix protein which sequence is set forth in SEQ ID NO: 1 with perlecan and GRP75.

Figure 17:
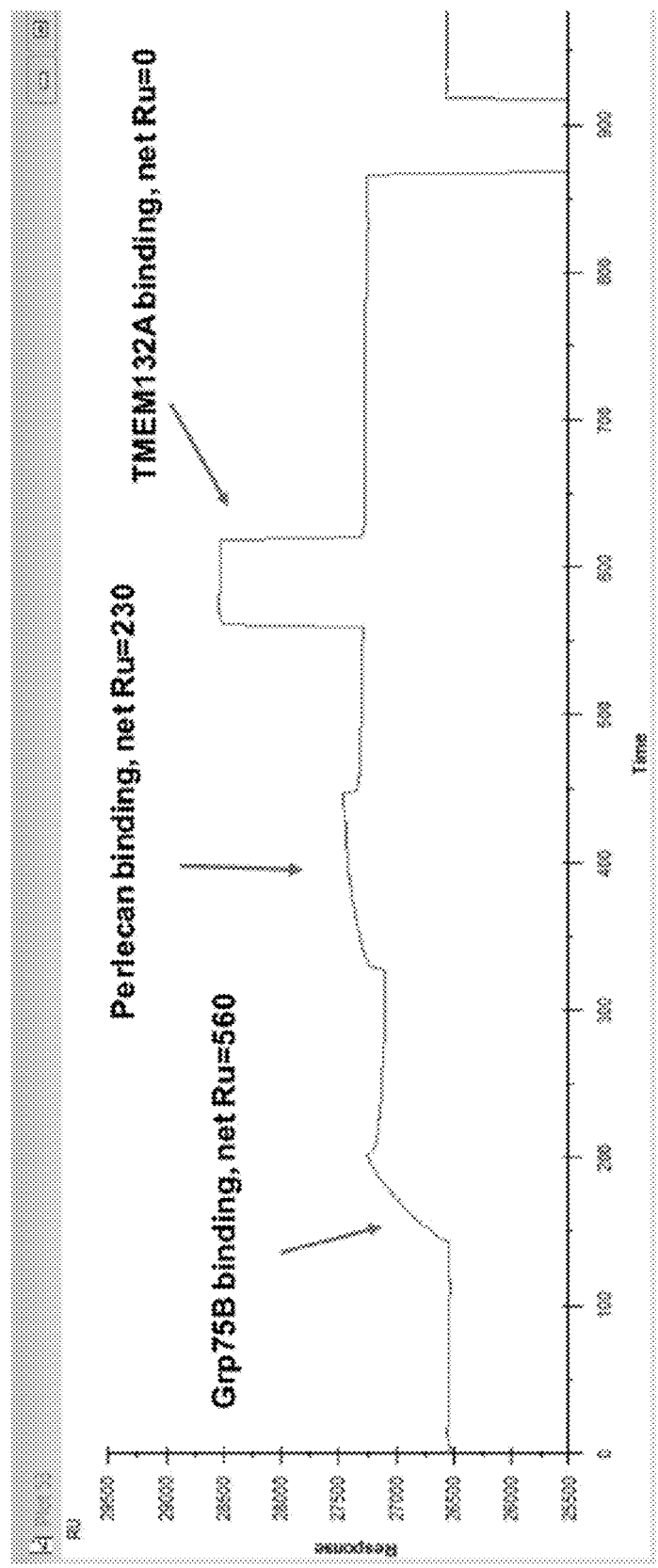

FIG. 17 shows significant Biacore™ binding interactions of the full-length Cholix protein which sequence is set forth in SEQ ID NO: 1 with GRP75, perlecan, and TMEM132A.

FIGS. 18A-18D show the fate of human growth hormone (hGH, SEQ ID NO: 190) that was administered by intraluminal injection (ILI, luminal surface is indicated as a white arrow in FIG. 18A-FIG. 18F) into the rat jejunum in vivo was evaluated first as a negative control expecting transport to lysosomes after cellular uptake.

Figure 18A:
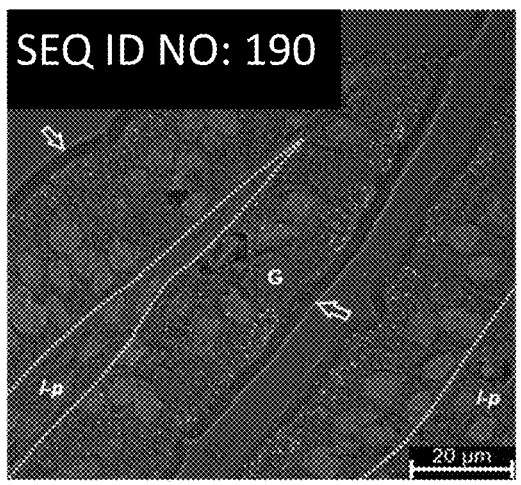

FIG. 18A shows that localization of hGH (SEQ ID NO: 190) 15 minutes post injection (ILI) was limited to a small population of vesicles in the apical region of epithelial cells as demonstrated by green immunofluorescence detection.

Figure 18B:
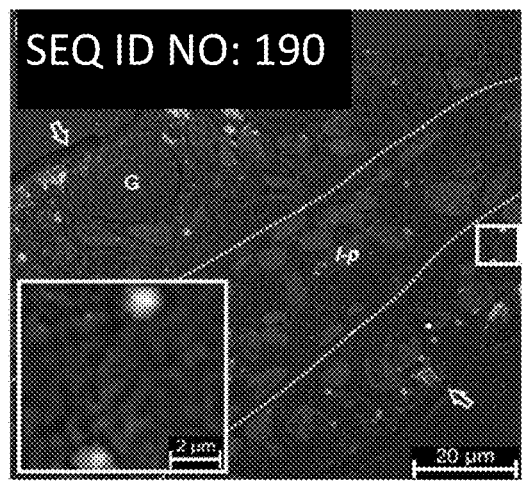
Figure 18C:
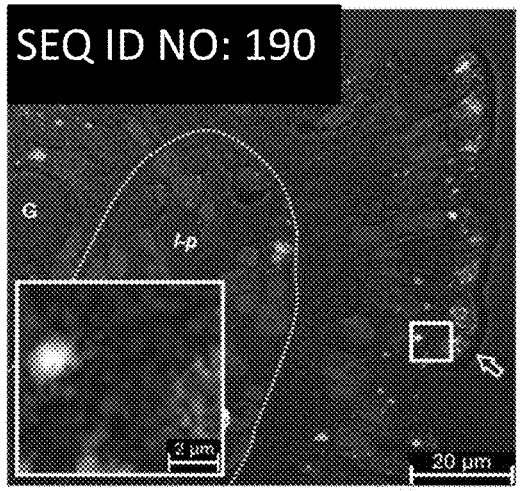
Figure 18D:
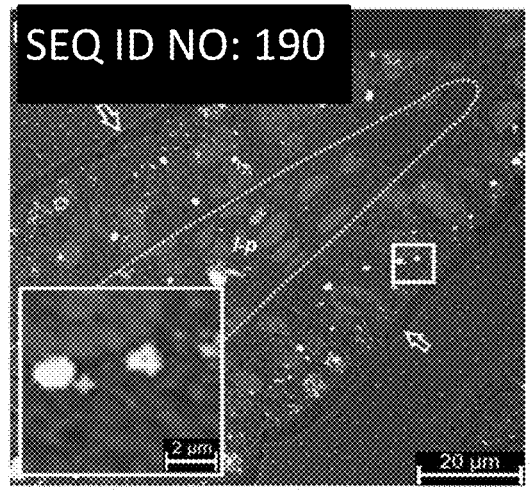

FIG. 18B, FIG. 18C, and FIG. 18D show that 15 min post ILI, hGH (SEQ ID NO: 190) was co-localized with lysosomal-associated membrane protein 1 (LAMP1, red fluorescence) (FIG. 18B) and Ras-related protein (Rab7, purple fluorescence) (FIG. 18C) with about the same frequency and characteristics of resident LAMP1$^+$, Rab7$^+$ lysosomes (FIG. 18D), indicating that hGH was directed to the lysosomal destructive (e.g., recycling) pathway shortly after uptake into the epithelial cells.

Figure 18E:
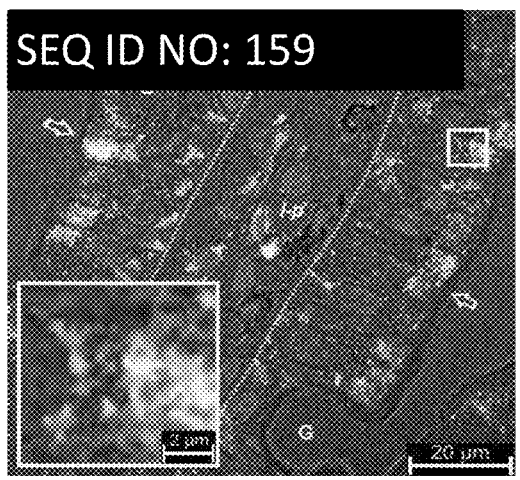
Figure 18F:
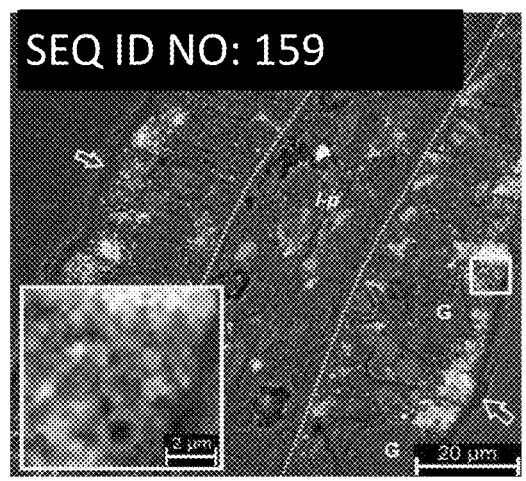

FIG. 18E and FIG. 18F show that a delivery construct (SEQ ID NO: 159) that includes a Cholix derived carrier (SEQ ID NO: 134) coupled to hGH (SEQ ID NO: 146) via a spacer (SEQ ID NO: 175), was directed away from the lysosomal pathway and thus did not show co-localization with either LAMP1 (FIG. 18E) or Rab7 (FIG. 18F), thereby enabling transcytosis of functional payload across polarized epithelial cells into the lamina propria.

Figure 19A:
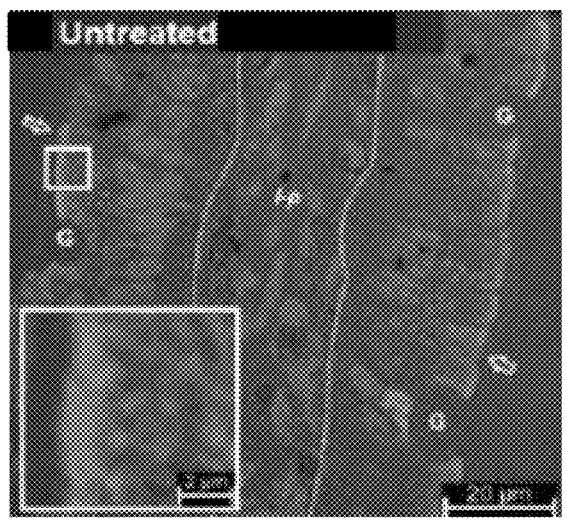
Figure 19B:
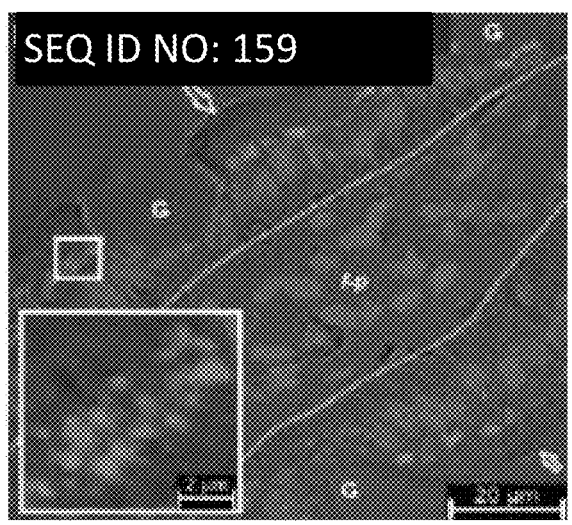

FIG. 19A shows that coating protein I (COPI, red fluorescence) distribution was restricted to the luminal apical membrane and apical vesicular compartment of epithelial cells prior to luminal injection of a delivery construct (SEQ ID NO: 159) that includes a Cholix derived carrier (SEQ ID NO: 134) coupled to hGH (SEQ ID NO: 146) via a spacer (SEQ ID NO: 175). In comparison, following apical intraluminal injection (ILI, luminal surface is indicated as a white arrow in FIG. 19A-FIG. 19D) of the delivery construct (SEQ ID NO: 159), FIG. 19B shows that COPI redistributed to a supra-nuclear location, indicating co-localization of the vesicles containing both the delivery construct with SEQ ID NO: 159 and COPI. Blue fluorescence indicates DAPI staining. Measurements in FIGS. 19A-19D were carried out 15 minutes post-ILI.

Figure 19C:
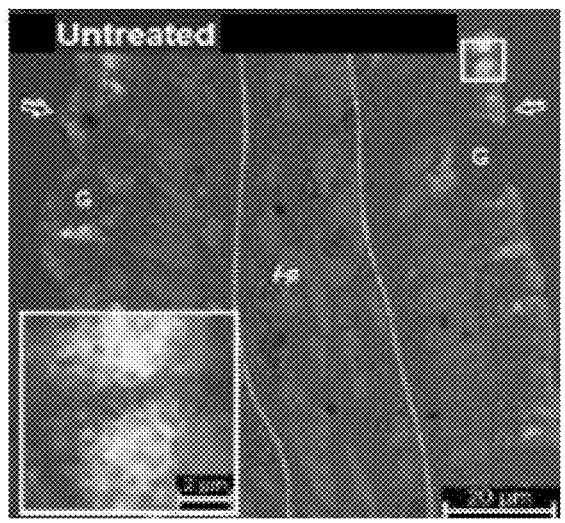

FIG. 19C shows that LMAN1 (green fluorescence) co-localized with COPI (red fluorescence) in the apical region (highlighted by white arrow) of polarized epithelial cells prior to injection of a delivery construct (SEQ ID NO: 159).

Figure 19D:
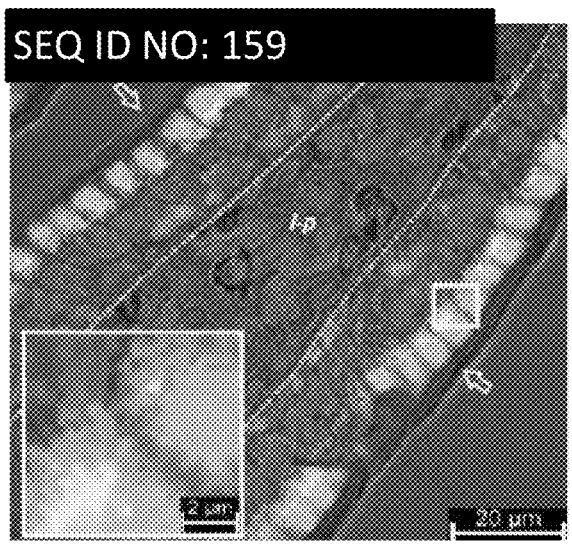

FIG. 19D shows that, following apical ILI (highlighted by white arrow) of the delivery construct (SEQ ID NO: 159), LMAN1 interacted and distributed with the delivery construct to the basal region of the epithelial cell, which is adjacent to the lamina propria (denoted as "l-p"). Thus, an LMAN1 redistribution mechanism appears to be used by Cholix carriers to move from the apical side of the epithelial cell to a basal compartment.

FIGS. 19E-19H show trafficking of a Cholix carrier (SEQ ID NO: 134) from apical (indicated by white arrow #1) to basal (indicated by white arrow #2) compartments in epithelial cells 5 (FIG. 19F), 10 (FIG. 19G), and 15 min (FIG. 19H) after luminal injection of a delivery construct (SEQ ID NO: 159) comprising a Cholix-derived carrier (SEQ ID NO: 134) coupled to an hGH (SEQ ID NO: 146) in rat jejunum. Cholix carrier localization is shown by green fluorescence, ERGIC receptor localization is shown by red fluorescence, and localization of another marker of ERGIC that may play a role in apical to basal trafficking (also referred to herein as ER-Golgi trafficking protein complex) is shown by purple fluorescence; thus interaction of Cholix carrier and ERGIC receptor is shown by yellow fluorescence, interaction of Cholix carrier and ER-Golgi trafficking protein complex is shown by pink fluorescence, and interaction and/or co-localization of Cholix carrier, ERGIC receptor, and ER-Golgi trafficking protein complex is shown by white spots (overlay of green, red, and purple fluorescence). DAPI staining is indicated by blue fluorescence.

Figure 19E:
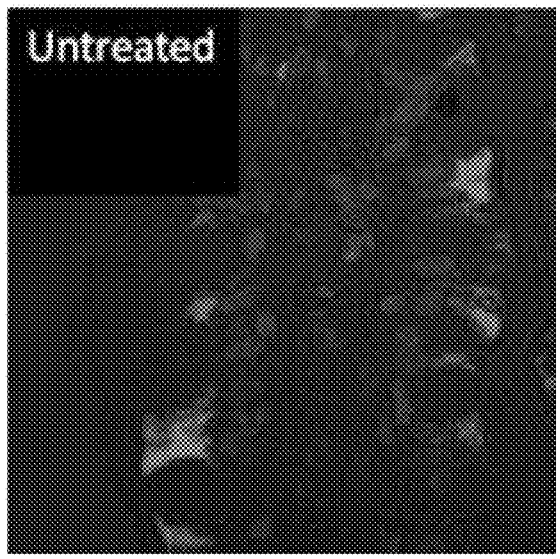

FIG. 19E shows untreated polarized gut epithelial cells.

Figure 19F:
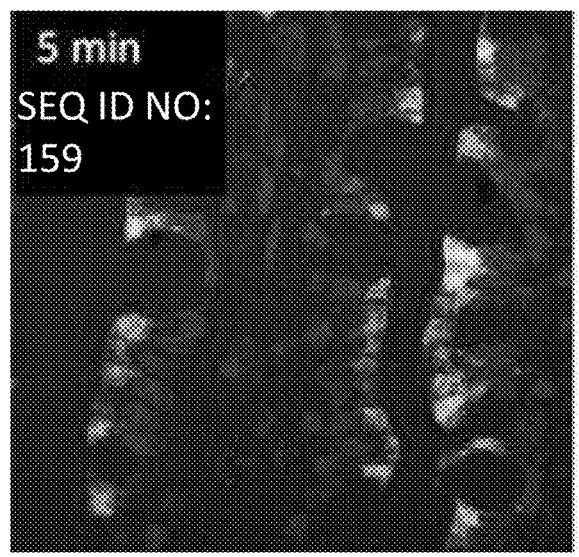

FIG. 19F shows localization and interaction of the Cholix carrier (SEQ ID NO: 134) with ER-Golgi trafficking protein complex 5 minutes after luminal injection in apical compartment as indicated by pink fluorescence signal in apical compartments.

Figure 19G:
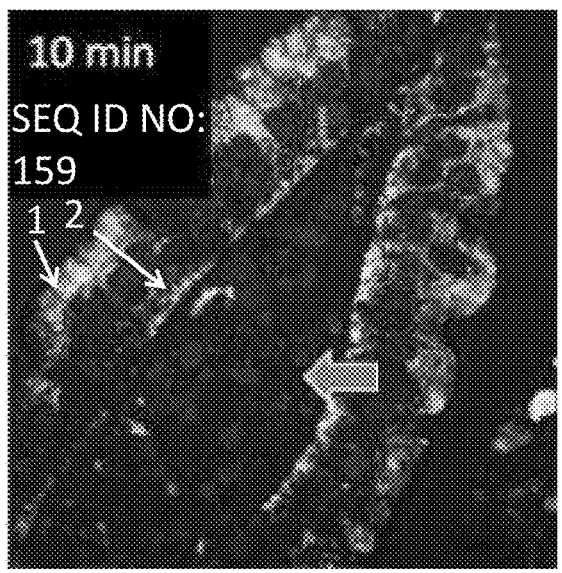

FIG. 19G shows trafficking of the Cholix carrier (SEQ ID NO: 134) in association with ERGIG-53 to the basal membrane 10 minutes after luminal injection followed by basal release of the carrier (and construct) into the lamina propria (gold arrow). These data demonstrate that a Cholix-derived carrier can utilize specific interactions with ERGIC proteins (e.g., ERGIC-53) to "hijack" vesicular trafficking from apical to basal compartments of a polarized epithelial cell.

Figure 19H:
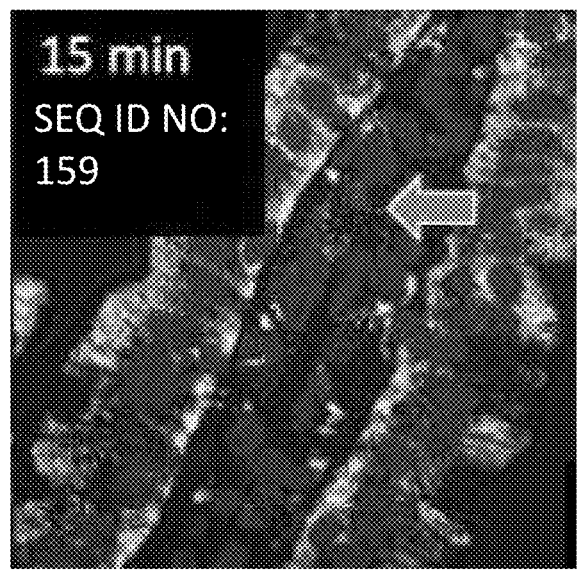

FIG. 19H shows increased amounts of Cholix carrier (SEQ ID NO: 134) present in the lamina propria 15 minutes after luminal injection.

Figure 19I:
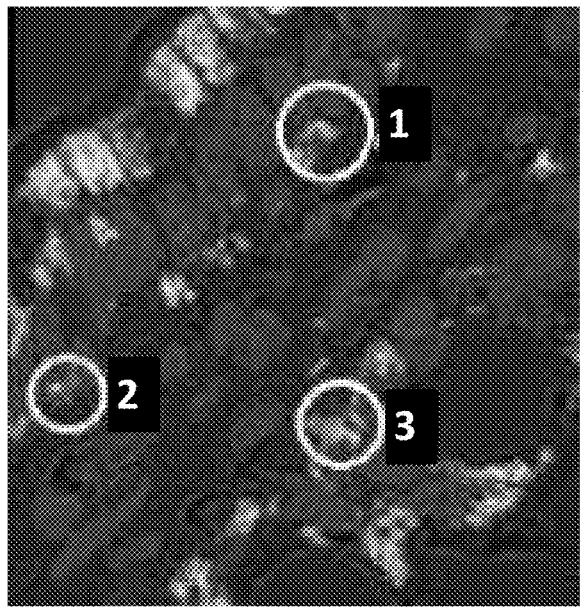
Figure 19J:
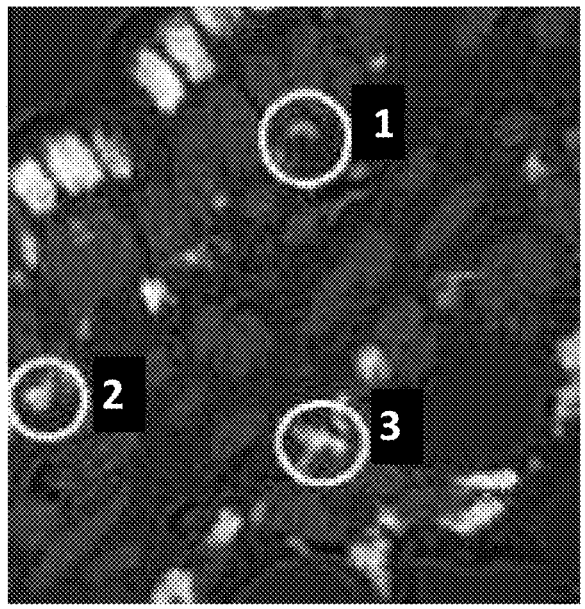
Figure 19K:
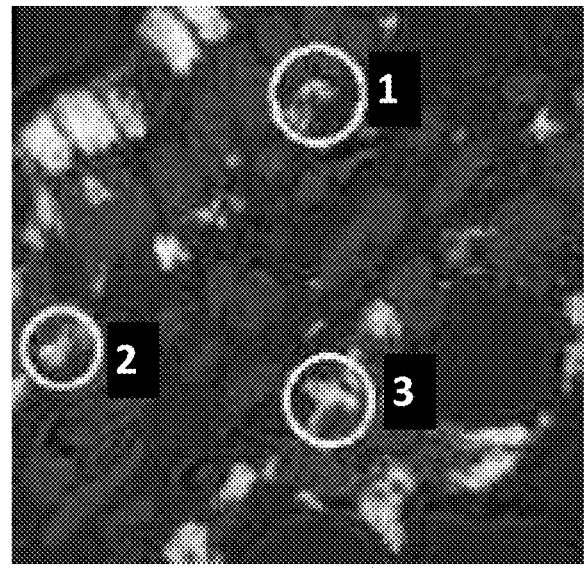

FIGS. 19I-19K show that a Cholix carrier (SEQ ID NO: 134) utilized basal protein secretion mechanisms to traffic through a polarized epithelial cell into the lamina propria. The fluorescence microscopy images were acquired 15 min after luminal injection of a delivery construct (SEQ ID NO: 159) comprising a Cholix-derived carrier (SEQ ID NO: 134) coupled to an hGH (SEQ ID NO: 146) in rat jejunum, and show that basal vesicles (highlighted by white circles and numbers "1-3" in different epithelial cells) can contain Cholix carrier and ERGIC-53 receptor, Cholix carrier and basal secretion protein, or all three of Cholix carrier, ERGIC receptor, and basal secretion protein. Cholix carrier localization is shown by green fluorescence (using an anti-Cholix carrier antibody), ERGIC-53 receptor localization is shown by red fluorescence, and localization of basal secretion protein is shown by purple fluorescence; thus interaction of Cholix carrier and ERGIC-53 receptor is shown by yellow fluorescence, interaction of Cholix carrier and the basal secretion protein perlecan is shown by pink fluorescence, and interaction and/or co-localization of Cholix carrier, ERGIC-53 receptor, and perlecan is shown by white spots (overlay of green, red, and purple fluorescence). DAPI staining is indicated by blue fluorescence.

FIG. 19I shows that basal compartment vesicles contained Cholix carrier (SEQ ID NO: 134) and ERGIC-53 receptor as indicated by yellow fluorescence.

FIG. 19J shows that basal compartment vesicles contained Cholix carrier (SEQ ID NO: 134) and perlecan as indicated by pink fluorescence.

FIG. 19K shows that basal compartment vesicles contained Cholix carrier (SEQ ID NO: 134), ERGIC-53 receptor, and perlecan as indicated by white spots (e.g., overlay of green, red, and purple fluorescence).

Figure 20A:
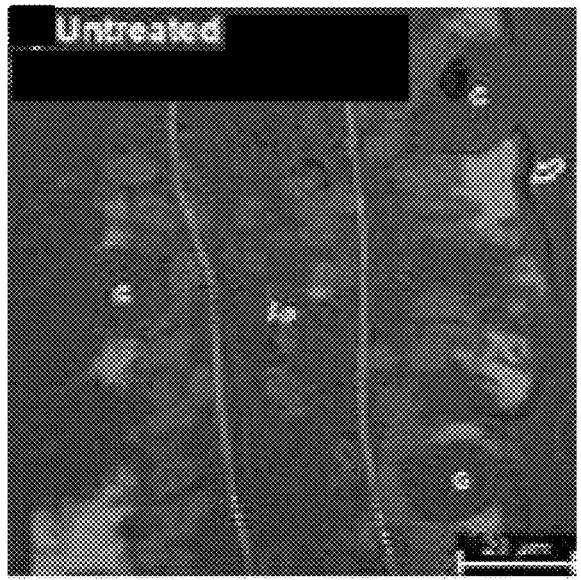

FIG. 20A shows the distribution of another endoplasmic reticulum-Golgi-intermediate compartment (ERGIC) element, SEC22b, in the absence of a delivery construct (SEQ ID NO: 159). In untreated (i.e., no injection of a delivery construct) tissues, SEC22b and LMAN1 extensively co-localized in the apical compartment while LMAN1 alone was separately observed close to the apical plasma membrane. In FIGS. 20A-20D, red fluorescence shows localization of LMAN1, purple fluorescence shows localization of SEC22b, green fluorescence shows localization of hGH, white arrow indicates the apical surface, and "G" indicates Goblet cells.

Figure 20B:
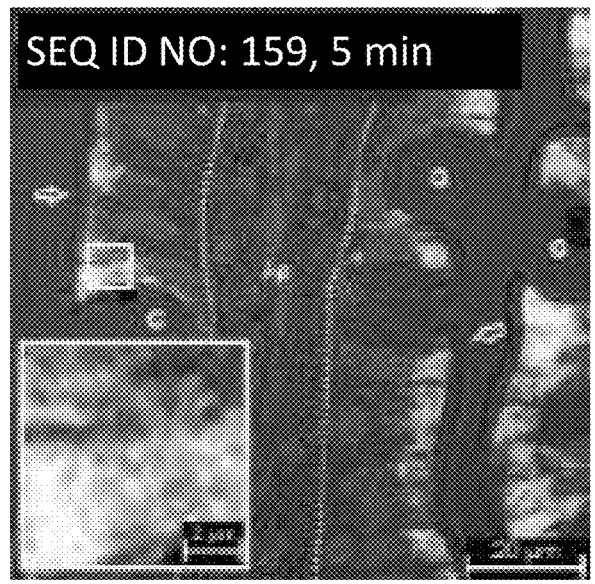

FIG. 20B shows that 5 minutes after ILI of a delivery construct (SEQ ID NO: 159) including a Cholix carrier (SEQ ID NO: 134) coupled to hGH (SEQ ID NO: 146), LMAN1, SEC22b, and hGH co-localized in the apical compartment but not significantly in basal compartments of epithelial cells.

Figure 20C:
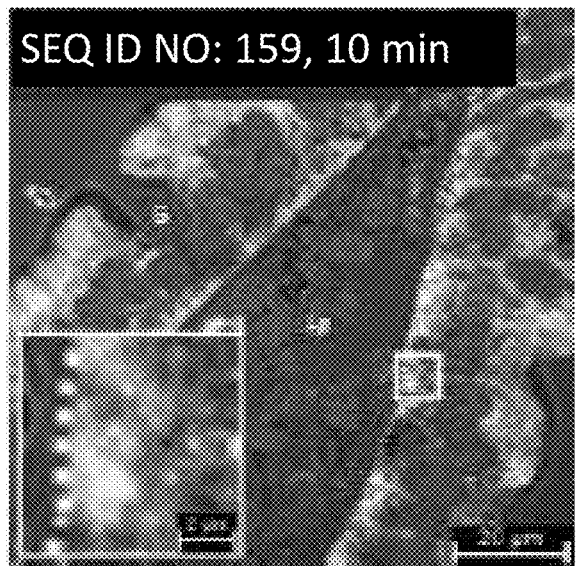

FIG. 20C shows that 10 min post ILI, the delivery construct (SEQ ID NO: 159) and LMAN1 were observed to co-localize in the basal compartment of epithelial cells without SEC22b, confirming that LMAN1 interacted and moved with the delivery construct inside the vesicle from the apical to the basal vesicular compartment of epithelial cells.

Figure 20D:
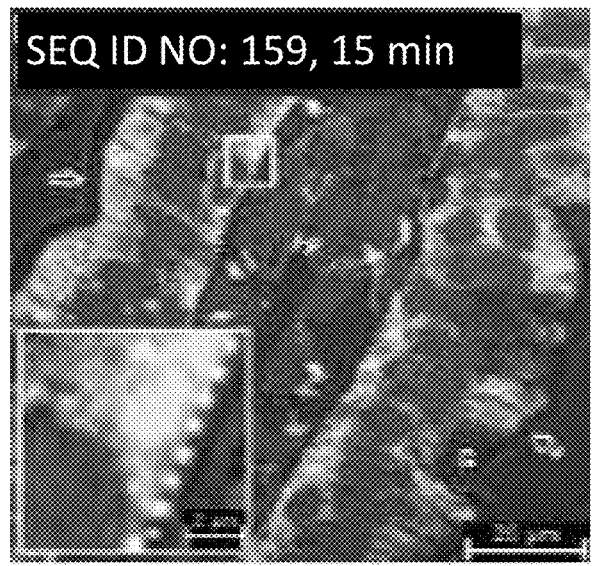
Figure 20E:
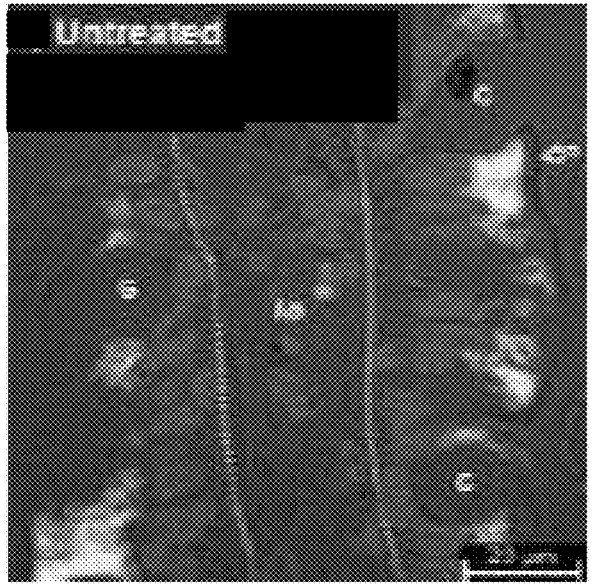
Figure 20F:
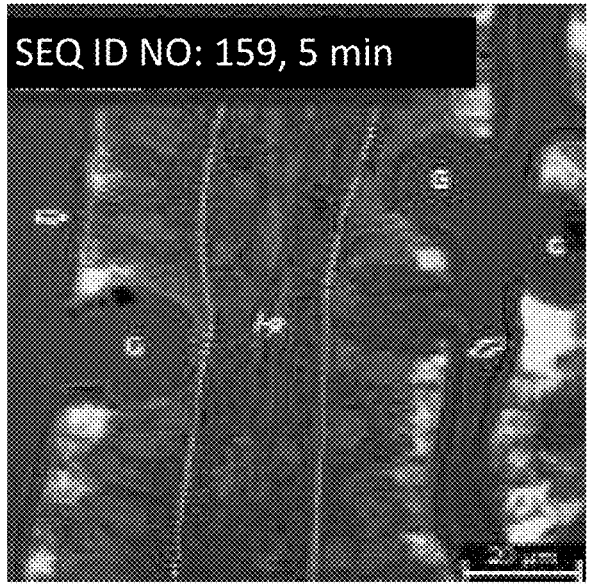
Figure 20G:
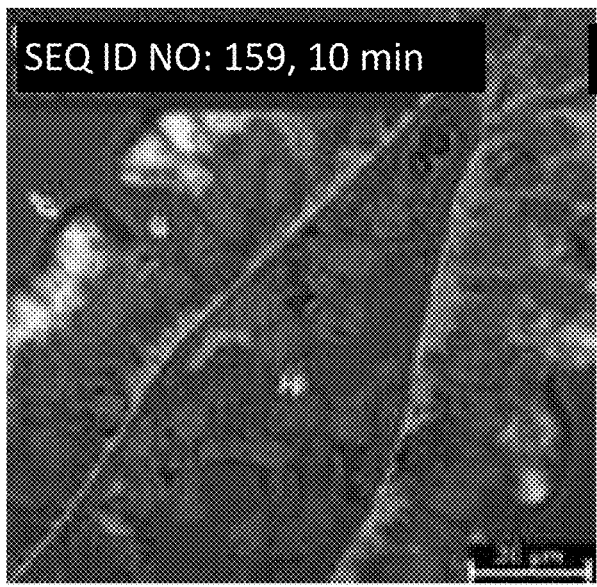
Figure 20H:
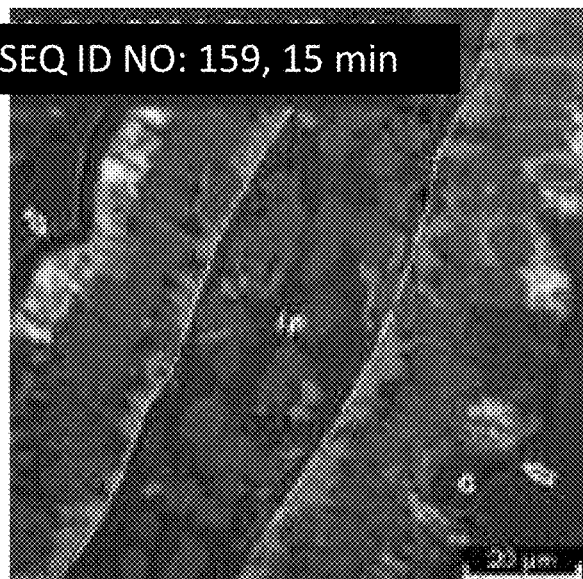

FIG. 20D shows that the extent of delivery construct (SEQ ID NO: 159) and LMAN1 co-localizing in the basal compartment 15 min post ILI had increased, with an increasing amount of hGH reaching the lamina propria over time.

FIG. 20E-FIG. 20H show the same tissue sections as described above and shown in FIG. 20A-FIG. 20D but showing only LMAN1 and SEC22b signals (no hGH signal). This demonstrates the profound redistribution of LMAN1 to the basal compartment without a redistribution of SEC22b in response to apical application of a delivery (SEQ ID NO: 159). These data demonstrate that delivery constructs comprising a Cholix derived carrier can utilize endogenous Cholix trafficking pathways that allow rapid and efficient transport of payload across the gut epithelium by coupling such payload to the carrier.

FIGS. 21A-21E show an exemplary surface model of a Cholix derived carrier consisting of SEQ ID NO: 178 (includes amino acid residues 1-265 of SEQ ID NO: 1 and an N-terminal methionine) which was used to highlight selected regions of interest that can play a role in certain functionalities related to apical to basal transcytosis, as well as their relative position and proximity on the protein surface. Amino acid regions located within residues $V^1$ and $E^{39}$ are adjacent to surface exposed amino acids $D^{150}$-$K^{186}$ and $K^{186}$-$L^{205}$. Specifically, $L^{17}$-$I^{25}$ (region X1, SEQ ID NO: 160) and $T^{170}$-$I^{176}$ (region X2, SEQ ID NO: 161) coordinate to form a pocket surrounded by several negative charges. Similarly, $K^{186}$-$H^{202}$ (region X3, SEQ ID NO: 162) coordinates with $I^{31}$-$E^{39}$ (region X4, SEQ ID NO: 163) to form a continuous ridge structure. In addition, the surface model shows residues $D^{135}$-$N^{139}$ (region X5, SEQ ID NO: 164), and the asparagine residues (e.g., potential glycosylation sites).

FIG. 21A shows the amino acid sequence of a Cholix polypeptide with SEQ ID NO: 178.

FIG. 21B shows the location of regions X1, X3 and X4.

FIG. 21C shows the location of regions X1 and X2, as well as X3 and X4.

FIG. 21D shows the location of regions X1, X2, X4 and X5.

FIG. 21E shows the location of regions X1, X2, X3, X4 and X5.

FIGS. 22A-22L illustrate a trafficking pathway analysis for a derived delivery construct (SEQ ID NO: 149). The delivery construct comprised a Cholix derived carrier (SEQ ID NO: 135) coupled to an active, secreted form of IL-10 (SEQ ID NO: 145) via a glycine-serine spacer (SEQ ID NO: 176). In FIGS. 22A-22L the white arrow #1 highlights the apical surface, white arrow #2 highlights the basal surface, and white arrow #3 highlights the lamina propria.

Figure 22A:
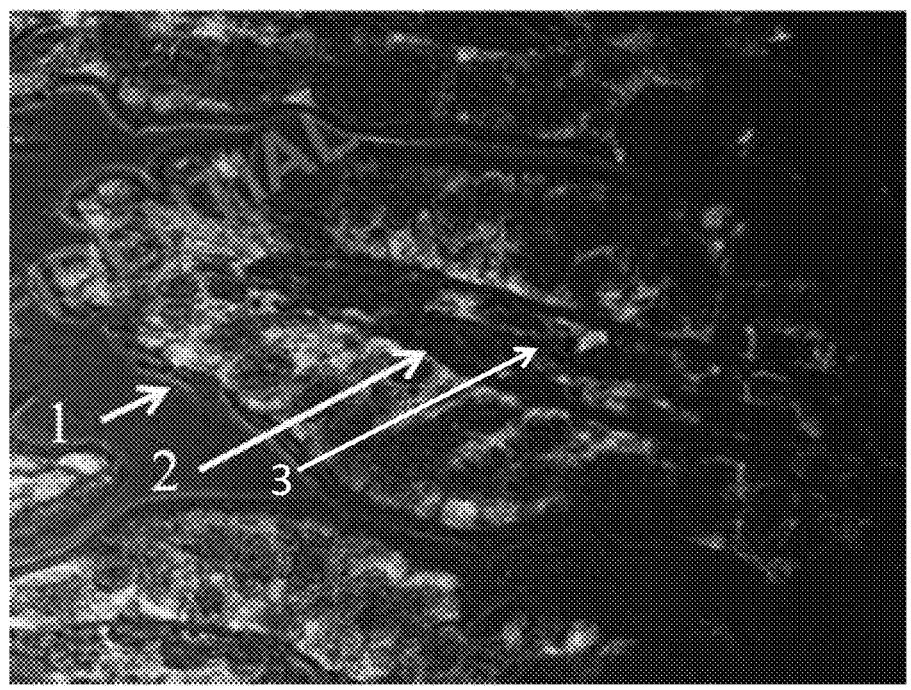

FIG. 22A shows that the delivery construct (SEQ ID NO: 149) strongly co-localized with the EEA1 antigen in cellular locations consistent with trafficking at both the apical and basal compartments of epithelial cells, suggesting the presence of the Cholix derived delivery construct in early endosome compartments. Red fluorescence shows localization of the EEA1 antigen, and the green fluorescence shows localization of IL-10.

Figure 22B:
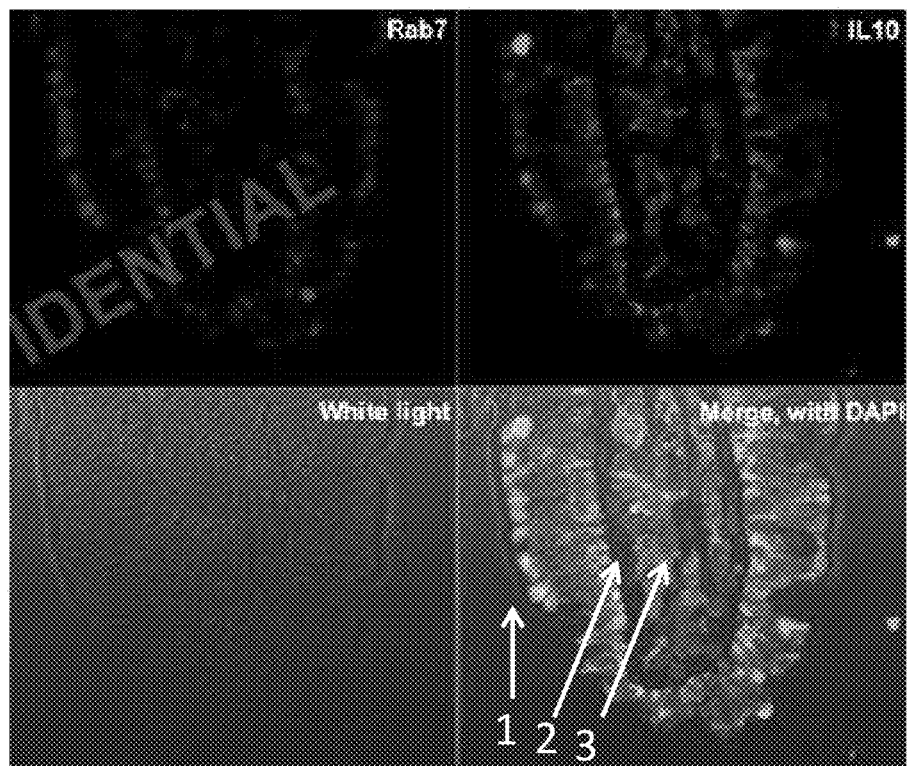

FIG. 22B show that the delivery construct (SEQ ID NO: 149) strongly co-localized with the Rab7 (top left) predominantly in the apical compartment of epithelial cells, but with only limited co-localization in cells within the lamina propria, suggesting the presence of the Cholix derived delivery construct in late endosome compartments (bottom left shows white light image, and bottom right shows merged staining with DAPI staining is shown in blue, red fluorescence showing localization of the EEA1 antigen, and green fluorescence showing localization of IL-10).

Figure 22C:
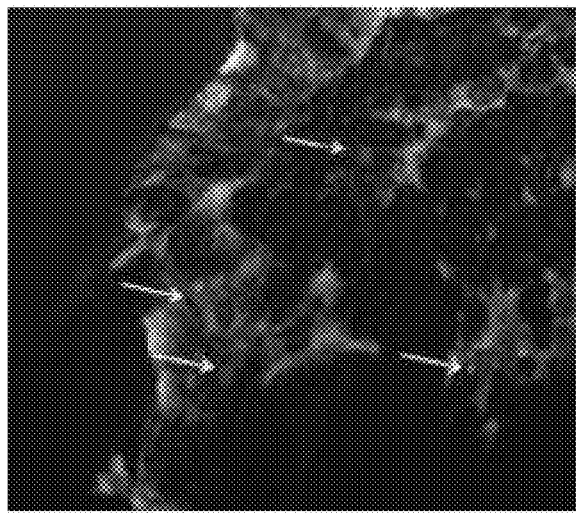

FIG. 22C shows that LAMP1 was identified in large, specific vesicles consistent with mature lysosomes that were devoid of the delivery construct (SEQ ID NO: 149) (white arrows, red fluorescence showing localization of the EEA1 antigen, and green fluorescence showing localization of IL-10). The delivery construct (SEQ ID NO: 149), however, co-localized with the LAMP1 antigen in cellular locations other than lysosome-like structures, consistent with vesicle trafficking at both the apical and basal compartments of epithelial cells, suggesting the presence of the Cholix derived delivery construct in late endosomal compartments.

Figure 22D:
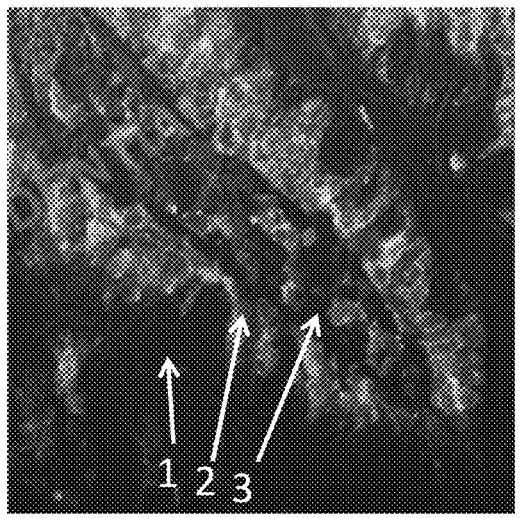

FIG. 22D shows that the delivery construct (SEQ ID NO: 149) construct also strongly co-localized with clathrin-coated vesicles, particularly in areas adjacent to the nucleus, and with Rab11a predominantly in the basal compartment of epithelial cells as well as in selected cells within the lamina propria. DAPI staining is shown in blue, red fluorescence shows localization of IL-10 antigen, and green fluorescence shows localization of clathrin.

Figure 22E:
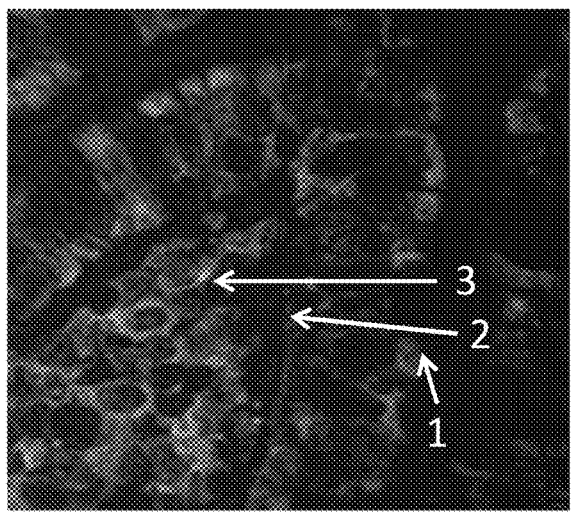

FIG. 22E shows that the delivery construct (SEQ ID NO: 149) co-localized with the endoplasmic reticulum as demonstrated by calnexin (red fluorescence showing localization of calnexin, and green fluorescence showing localization of IL-10) in a pattern adjacent to the nucleus in epithelial cells and in a large fraction of cells within the lamina propria. Specifically, the delivery construct (SEQ ID NO: 149) strongly co-localized with the endoplasmic reticulum Golgi intermediate compartment (ERGIC) and the LMAN1 antigen appeared to re-distribute in response to carrier endocytosis and transcytosis, as shown for 5 (FIG. 22F), 10 (FIG. 22G), and 15 minutes after injection (FIG. 22H).

Figure 22F:
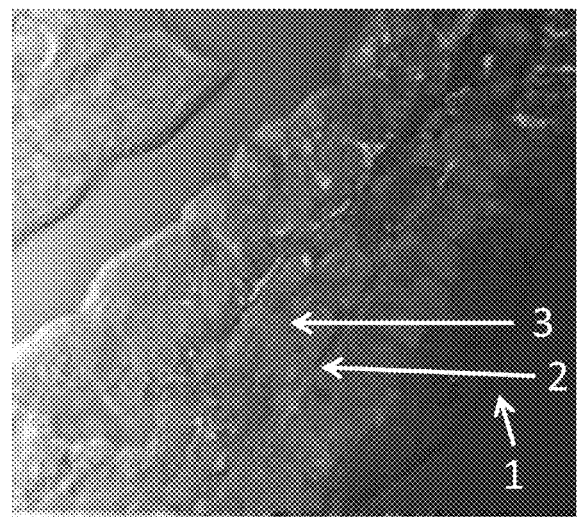

FIG. 22F shows that the delivery construct (SEQ ID NO: 149) strongly co-localized with the endoplasmic reticulum Golgi intermediate compartment 53 (ERGIC-53) and the LMAN1 antigen (red fluorescence showing localization of ERGIC-53 and LMAN1, and green fluorescence showing localization of IL-10, blue fluorescence shows DAPI staining) appeared to re-distribute in response to carrier endocytosis and transcytosis, as shown for 5 minute after injection.

Figure 22G:
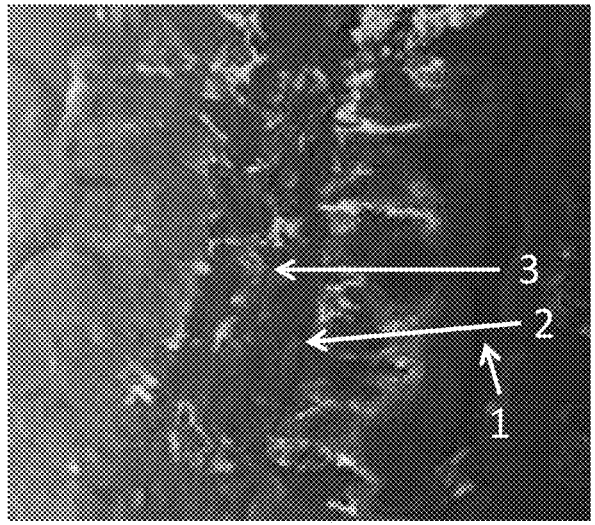

FIG. 22G shows the delivery construct (SEQ ID NO: 149) construct co-localized with LMAN1 antigen 10 minutes after injection. The data show significant localization of the delivery construct (SEQ ID NO: 149) in the lamina propria.

Figure 22H:
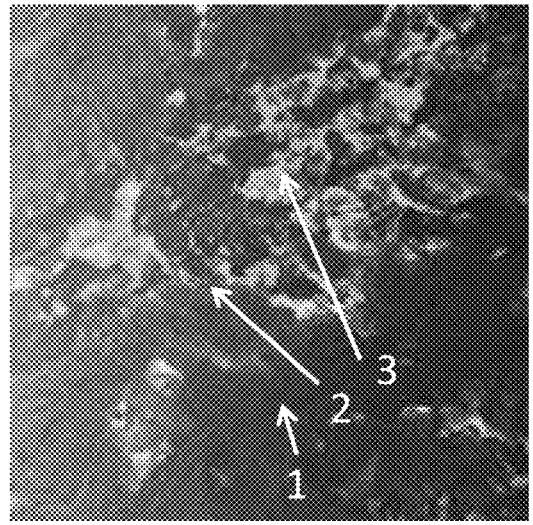

FIG. 22H shows the delivery construct (SEQ ID NO: 149) construct co-localized with LMAN1 antigen 15 minutes after injection. The data show significant localization of the delivery construct (SEQ ID NO: 149) in the lamina propria.

Figure 22I:
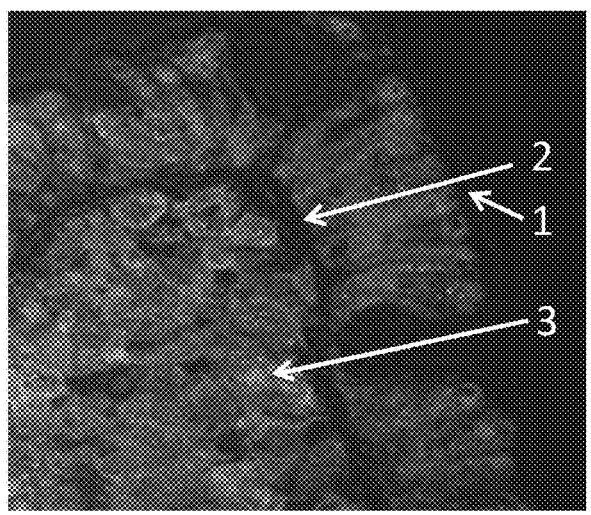

FIG. 22I shows that the delivery construct (SEQ ID NO: 149) did not co-localize with the low levels of giantin present in epithelial cells (red fluorescence showing localization of IL-10, and green fluorescence showing localization giantin, blue fluorescence shows DAPI staining). Some giantin co-localized with the construct in a subset of cells present in the lamina propria, suggesting that the Cholix derived carrier does not locate with the Golgi compartment.

Figure 22J:
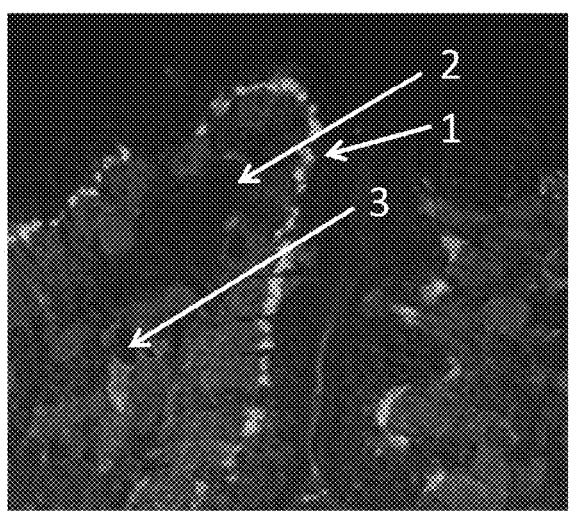

FIG. 22J shows that the 58K antigen localized in epithelial cells at a site apical to the nucleus and the delivery construct (SEQ ID NO: 149) showed some co-localization (red fluorescence showing localization of IL-10, and green fluorescence showing localization 58K Golgi antigen, blue fluorescence shows DAPI staining) with this protein in a manner that suggests a brief movement through this compartment. No 58K antigen was observed in cells within the lamina propria.

Figure 22K:
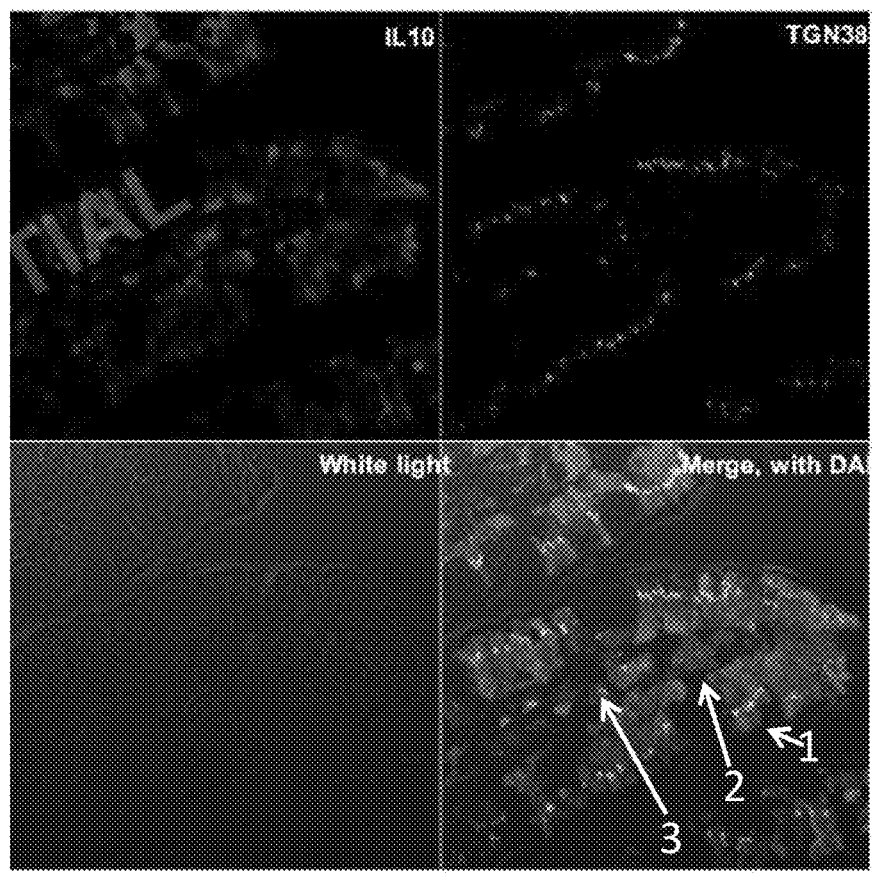

FIG. 22K shows that the delivery construct (SEQ ID NO: 149, top left, IL-10 localization) showed some level of co-localization with the TGN38 antigen (top right), which showed a cellular distribution that was restricted to the apical side of nuclei in epithelial cells and adjacent to the nucleus in a few cells within the lamina propria. Bottom left image shows a white light image and bottom right shows a merge (overlay) with IL-10 (red), TGN38 (green), and DAPI signal (blue fluorescence).

Figure 22L:
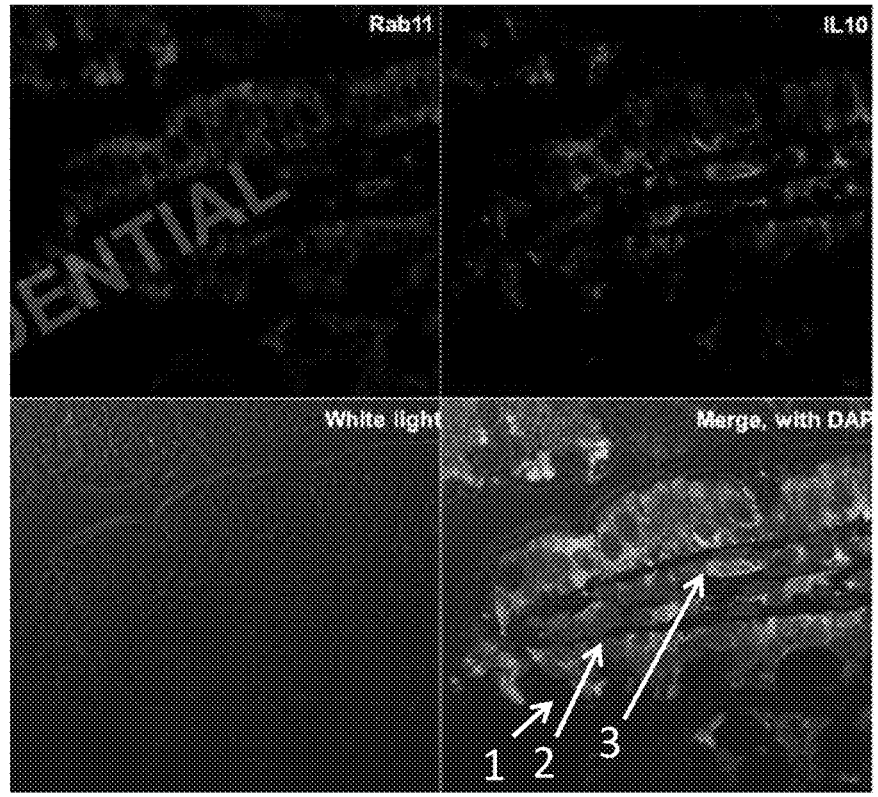

FIG. 22L shows that the delivery construct (SEQ ID NO: 149) (IL-10 localization shown by green fluorescence, top right) strongly co-localized with Rab11a (top left, localization shown by red fluorescence) predominantly in the basal compartment of epithelial cells and in selected cells within the lamina propria. Bottom left image shows a white light image and bottom right shows a merge (overlay) with IL-10 (green), Rab11a (red), and DAPI signal (blue fluorescence).

Figure 23A:
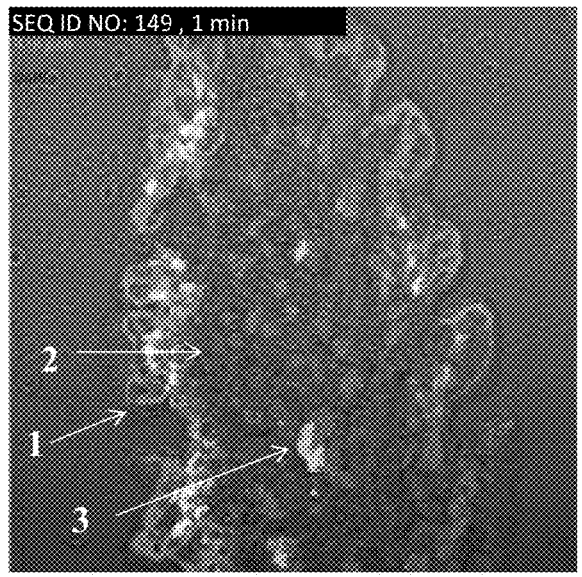
Figure 23B:
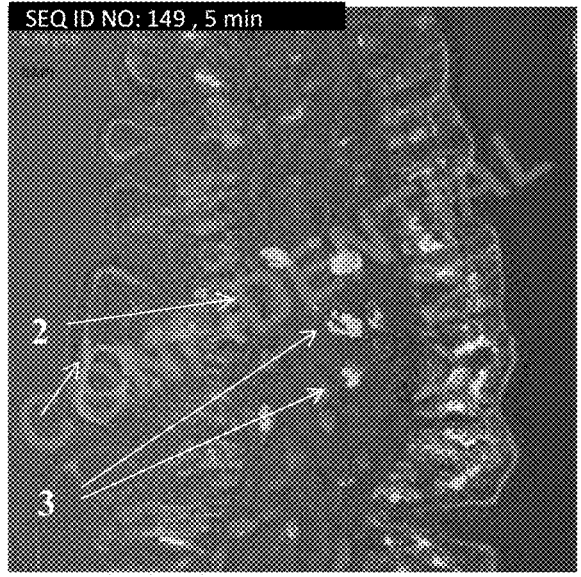
Figure 23C:
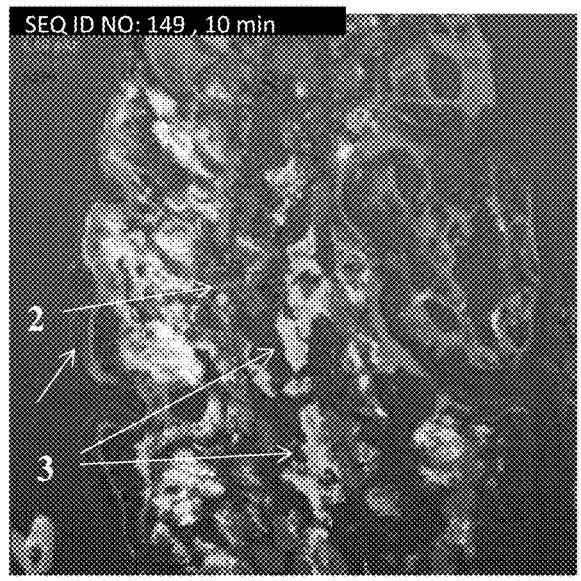

FIGS. 23A-23C show microscopy images demonstrating transcytosis of an IL-10 across polarized gut epithelial cells in Wistar rats at various time points following luminal application of the delivery construct with the sequence set forth in SEQ ID NO: 149 to rat jejunum. The delivery construct (SEQ ID NO: 149) included a carrier with SEQ ID NO: 135 coupled to an IL-10 payload having the amino acid set forth in SEQ ID NO: 145 via a spacer having an amino acid sequence set forth in SEQ ID NO: 176. Green fluorescence indicates the presence of IL-10 (via staining with an anti-IL-10 antibody). Blue fluorescence indicates DAPI staining, which labels DNA, and red fluorescence indicates the presence of CK-8 (cytokeratin-8) with which a Cholix-derived carrier can co-localize (e.g., in a supranuclear region of an epithelial cell) during transcytosis. The white arrows #1 highlight the apical membrane of the epithelial cells, and the white arrows #2 highlight the basal membrane of the epithelial cells.

FIG. 23A demonstrates the extent of transcytosis of IL-10 one minute after luminal application of the delivery construct with the sequence set forth in SEQ ID NO: 149 to rat jejunum. The data shows that transport of an IL-10 payload from the apical to the basal site and into the lamina propria occurred as early as 1 minute after application of the delivery construct. White arrow #3 indicates the presence of IL-10 in the lamina propria (see e.g., white arrows #3).

FIG. 23B demonstrates the extent of transcytosis of IL-10 five minutes after luminal application of the delivery construct with the sequence set forth in SEQ ID NO: 149 to rat jejunum. The data shows an increased amount of transported IL-10 payload that was present in the lamina propria (see e.g., white arrows #3) 5 minutes after luminal application of the delivery construct.

FIG. 23C demonstrates the extent of transcytosis of IL-10 ten minutes after luminal application of the delivery construct with the sequence set forth in SEQ ID NO: 149 to rat jejunum. The data shows an even higher amount of transported IL-10 payload that was present in the lamina propria (see e.g., white arrows #3) 10 minutes after luminal application of the delivery construct.

Figure 23D:
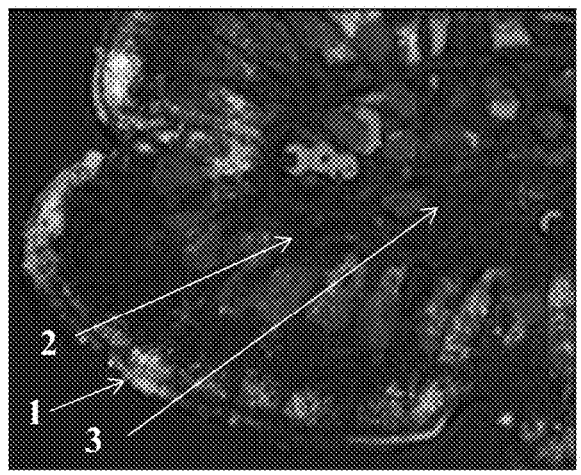
Figure 23E:
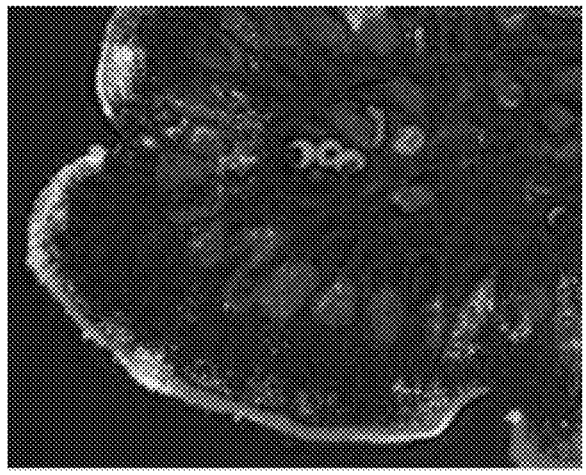
Figure 23F:
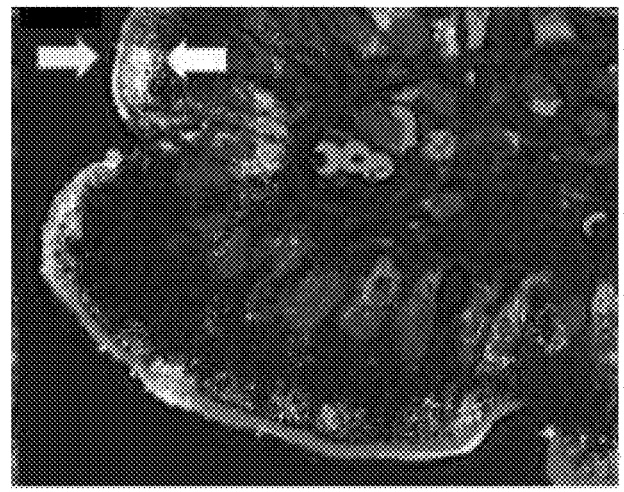

FIGS. 23D-23F show apical endocytosis and early trafficking of the Cholix carrier with SEQ ID NO: 135 in epithelial cells 1 min after luminal injection of the delivery construct (SEQ ID NO: 149) comprising the Cholix carrier with SEQ ID NO: 135 coupled to an IL-10 (SEQ ID NO: 145) in rat jejunum. The data shows that Cholix-derived carriers avoid the lysosomal destruction pathway by interacting with lysosome avoidance receptors. Cholix carrier localization is shown by green fluorescence, apical entry receptor TMEM132 localization is shown by red fluorescence; and localization of lysosome avoidance receptors is shown by purple fluorescence; thus interaction of Cholix carrier and the apical entry receptor TMEM132 is shown by yellow fluorescence, interaction of Cholix carrier and lysosome avoidance receptor is shown by pink fluorescence, and interaction and/or co-localization of Cholix carrier, apical entry receptor TMEM132, and lysosome avoidance receptor is shown by white spots (overlay of green, red, and purple fluorescence). DAPI staining is indicated by blue fluorescence.

FIG. 23D shows localization of the Cholix carrier (SEQ ID NO: 135) at the apical membrane (indicated by white arrow #1) of a polarized epithelial cell. Basal membrane is indicated by white arrow #2 and the lamina propria is indicated by white arrow #3.

FIG. 23E shows interaction of Cholix carrier (SEQ ID NO: 135) with apical entry receptor TMEM132 as indicated by yellow fluorescence at and around the apical membrane.

FIG. 23F shows that Cholix carrier (SEQ ID NO: 135), apical entry receptor TMEM132, and lysosome avoidance receptor are in close proximity at the apical membrane as shown by white spots (e.g., overlay of green, red, and purple fluorescence) indicated by the white arrow. It is assumed that the lysosome avoidance receptor (GRP75) can approach a Cholix carrier-apical entry receptor complex, followed by dissociation of the Cholix carrier with the apical entry receptor TMEM132 and association of the Cholix carrier with the lysosome avoidance receptor GRP75 due to changes in the pH environment and the pH-dependency of these Cholix carrier-receptor interaction as shown, e.g., in FIG. 15B.

Figure 23G:
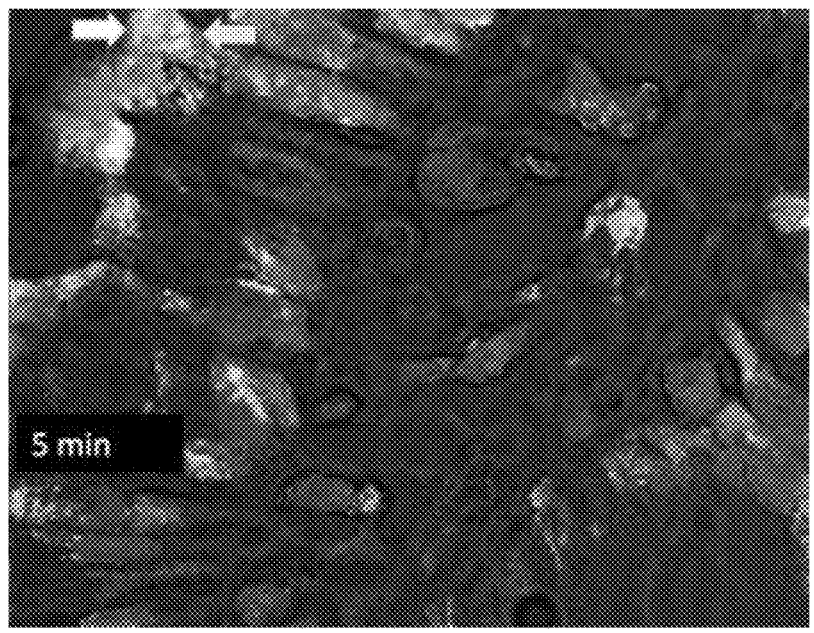
Figure 23H:
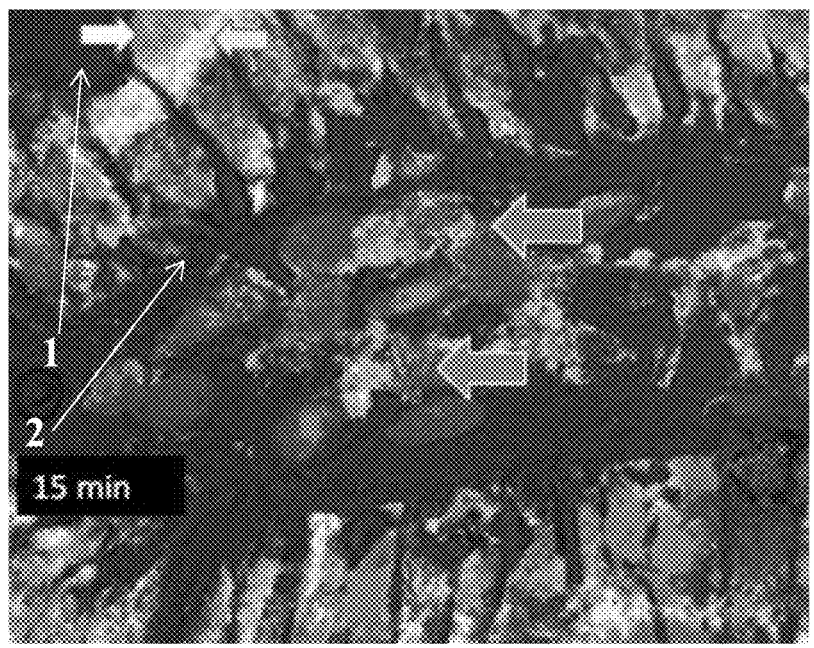

FIGS. 23G-23H show trafficking of a Cholix carrier (SEQ ID NO: 135) from apical to supranuclear compartments in epithelial cells 5 and 15 min after luminal injection of the delivery construct (SEQ ID NO: 149) comprising a Cholix-derived carrier (SEQ ID NO: 135) coupled to an IL-10 (SEQ ID NO: 145) in rat jejunum. Cholix carrier localization is shown by green fluorescence, ERGIC receptor localization is shown by red fluorescence, apical entry receptor (e.g., TMEM132) localization is shown by orange fluorescence; and localization of lysosome avoidance receptors is shown by purple fluorescence; thus interaction of Cholix carrier and ERGIC receptor is shown by yellow fluorescence, interaction of Cholix carrier and lysosome avoidance receptor is shown by pink fluorescence, and interaction and/or co-localization of Cholix carrier, apical entry receptor, and lysosome avoidance receptor is shown by white spots (overlay of green, red, and purple fluorescence). DAPI staining is indicated by blue fluorescence.

FIG. 23G shows localization of the Cholix carrier (SEQ ID NO: 135) in a polarized gut epithelial cell 5 minutes after luminal injection of the delivery construct (SEQ ID NO: 149). The data shows that, following apical receptor-mediated endocytosis, the Cholix carrier forms complexes with a lysosome avoidance receptor and apical entry receptor close to the apical membrane (indicated by white spots (overlay of green, red, and purple fluorescence) and highlighted by white arrow) and also starts interacting with ERGIC receptor as demonstrated by yellow fluorescence (and the yellow arrow) slightly closer to supranuclear regions within the cell.

FIG. 23H shows localization of the Cholix carrier (SEQ ID NO: 135) in a polarized gut epithelial cell 15 minutes after luminal injection of the delivery construct (SEQ ID NO: 149). The data shows that the carrier moved from apical to supranuclear compartments while associated with ERGIC (see yellow arrow), wherein the yellow fluorescence intensity is increased compared to 5 minutes post-injection, indicating increased Cholix carrier movement from apical to supranuclear regions over time. The data further shows localization of Cholix carrier at the basal membrane and in the lamina propria (gold arrows).

Figure 24:
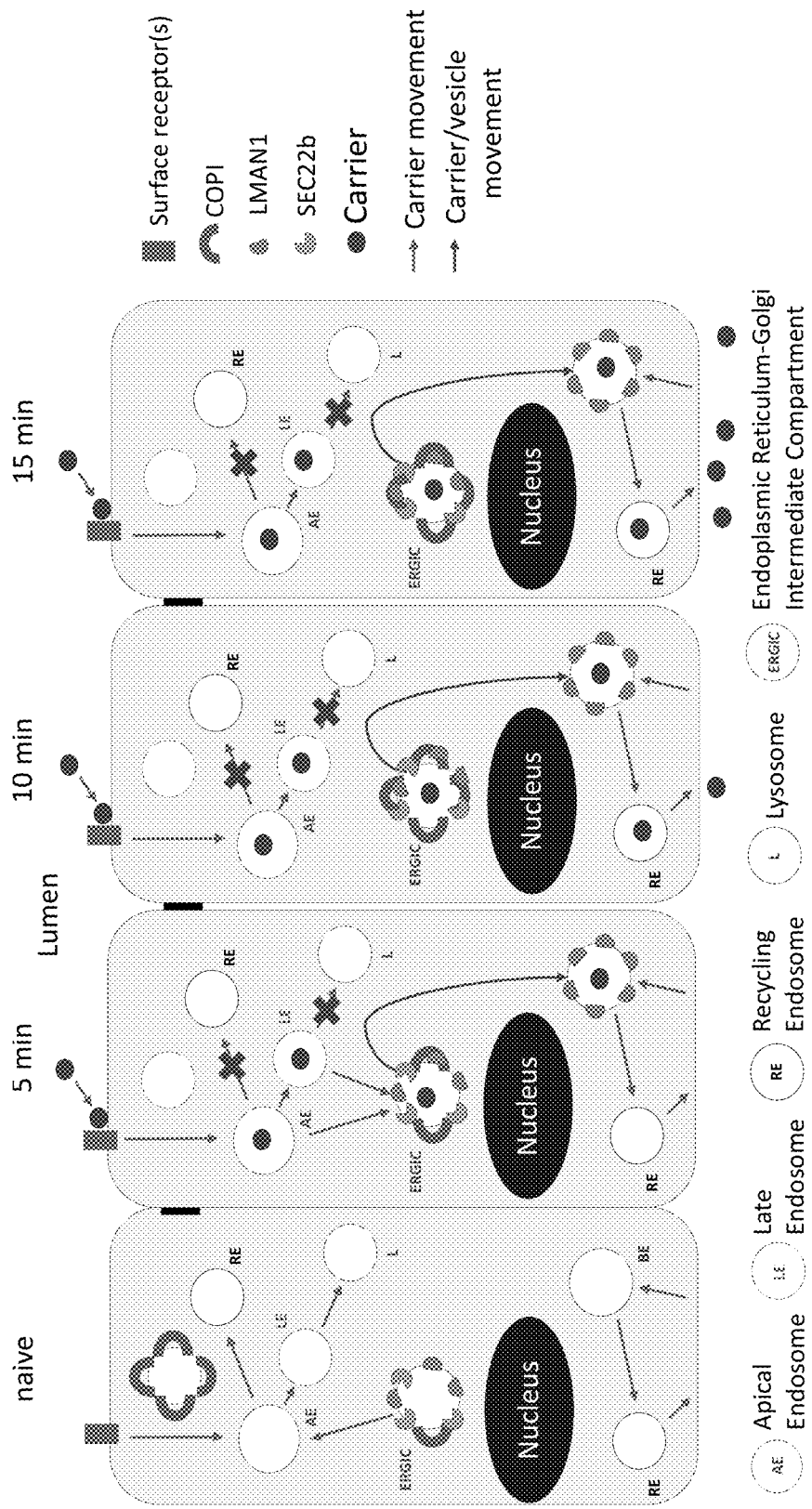

FIG. 24 shows a diagram of intracellular compartment elements (e.g., cellular regions, compartments, and receptors such as transport receptor interaction partners (or TRIPs) of carriers) involved in the apical to basal transcytosis of carriers described herein. The transcytosis process is schematically described over a 15-minute time course. For example, Cholix derived carriers capable of transcytosis may not or may not significantly enter lysosomes or apical recycling pathway(s) following endocytosis (e.g., as depicted by recycling endosomes or "RE"). Redistribution of COPI and LMAN1, but not SEC22b, following apical application of a Cholix derived carrier, as well as access to basal compartment recycling pathway(s) are shown as pathway characteristics of Cholix derived carriers. Thus, the Cholix derived carriers described herein can utilize a series of intracellular vesicular compartments to traffic through polarized intestinal epithelial cells that can culminate in apical to basal transcytosis and allow such carriers to rapidly and efficiently (e.g., at least 5%, 10%, 20%, 25%, or 50% of material applied to the apical surface) shuttle payload (e.g., therapeutic proteins) into the lamina propria.

Figure 25:
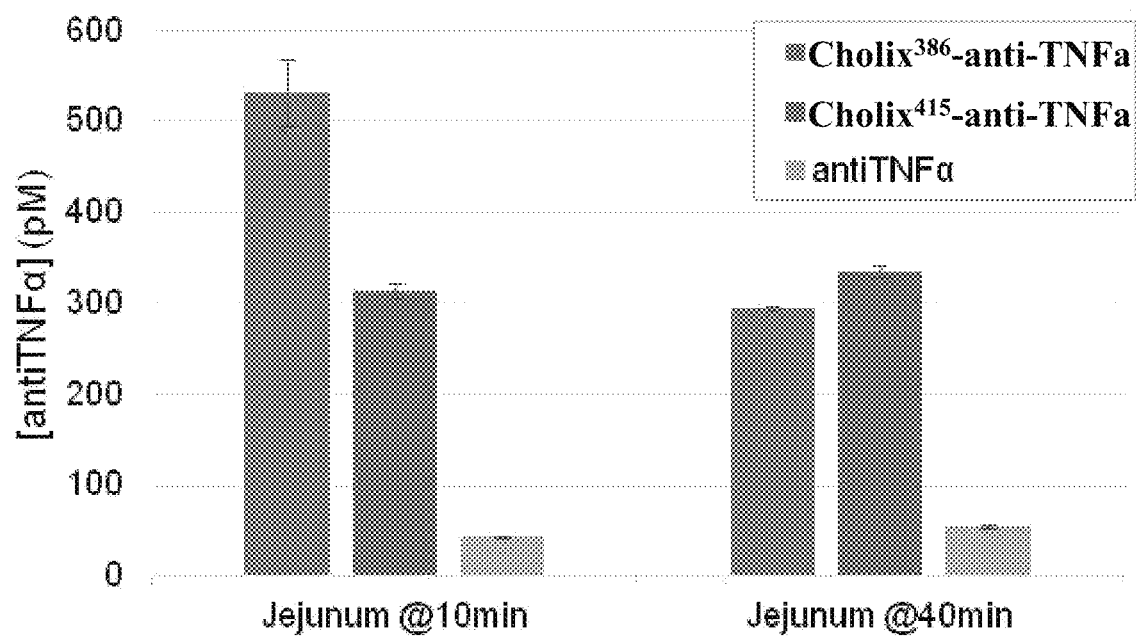

FIG. 25 shows that both a Cholix$^{386}$ derived carrier (e.g., SEQ ID NOs: 135 or 180) and a Cholix$^{415}$ derived carrier (e.g., comprising residues 1-415 of SEQ ID NO: 1) transport an anti-TNFα agent (e.g., an anti-TNFα antibody or functional fragment thereof) across intestinal epithelial cells at 10 minutes and at 40 minutes. Moreover, a Cholix$^{386}$-anti-TNFα construct transports at about 12× the rate of anti-TNF-α alone and a Cholix$^{415}$-anti-TNFα transports at ~7× the rate of anti-TNF-α alone.

Figure 26:
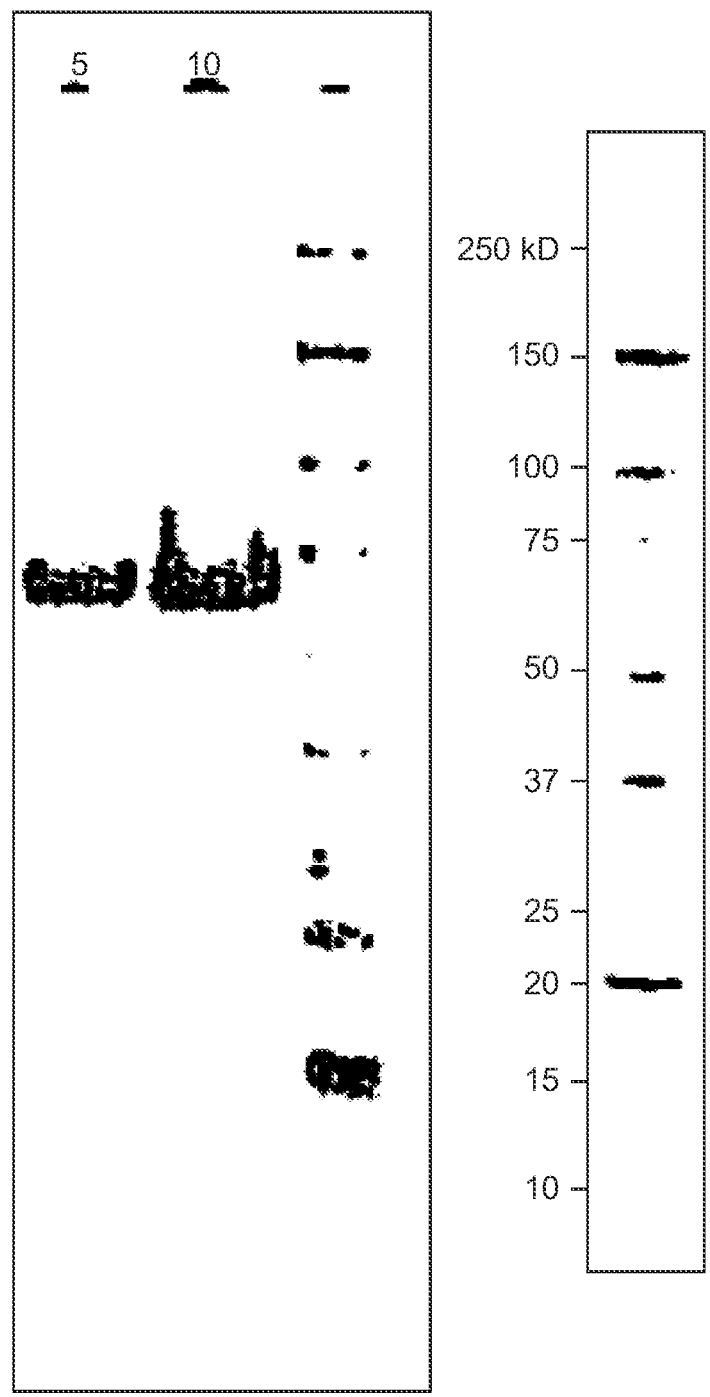

FIG. 26 shows the purity of SEQ ID NO: 192-Exenatide (SEQ ID NO: 192 crosslinked to Exenatide (SEQ ID NO: 195)) run on a COOMASSIE Blue-stained SDS-PAGE gel.

Figure 27:
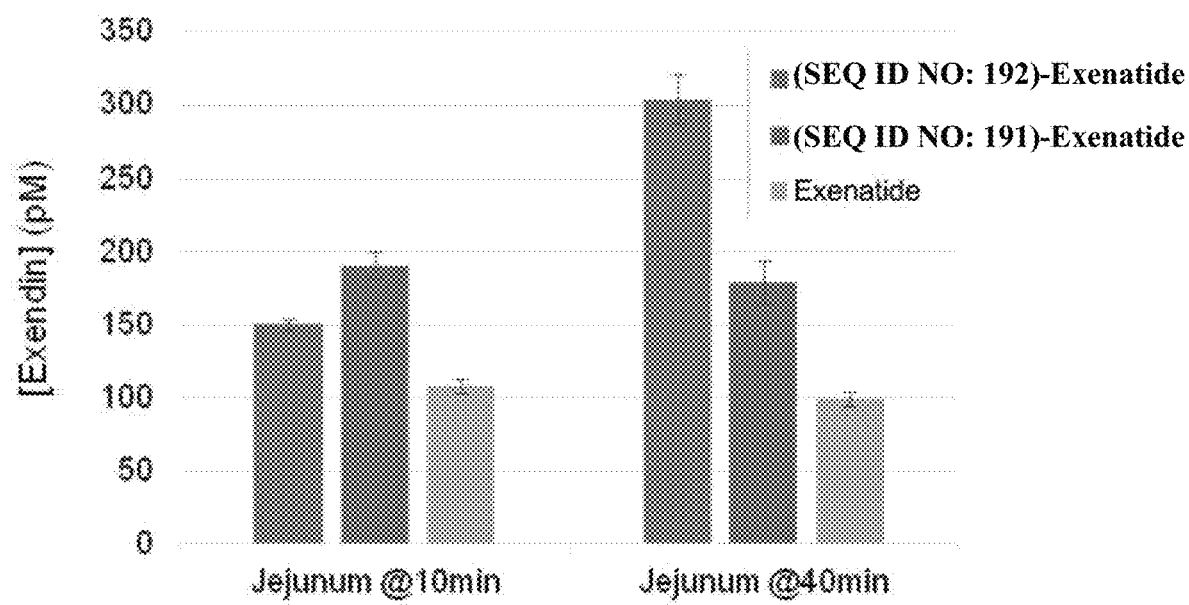

FIG. 27 shows in vivo trancytosis of Exenatide crosslinked to carriers SEQ ID NO: 191 or SEQ ID NO: 192 across the jejunum of Sprague Dawley Rats. The amount (in pM) of Exenatide transported across intestinal tissues was measured at 10 minutes and 40 minutes post treatment. The data shows that both SEQ ID NO: 191-Exenatide and SEQ ID NO: 192-Exenatide are capable of transport at a higher rate than Exenatide alone at 10 minutes and at 40 minutes.

Figure 28A:
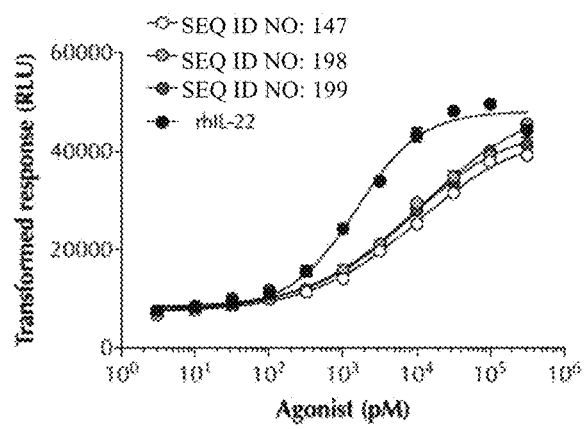

FIG. 28A shows that the length of amino acid spacers with SEQ ID NOs: 175, 196, and 197 did not impact the ability of IL-22 (SEQ ID NO: 142) when included in the delivery constructs with SEQ ID NOs: 147, 198, and 199 to induce IL-22 receptor dimerization. The induction of receptor dimerization of control recombinant human IL-22 (rhIL-22, SEQ ID NO: 143) is shown by the black curve.

Figure 28B:
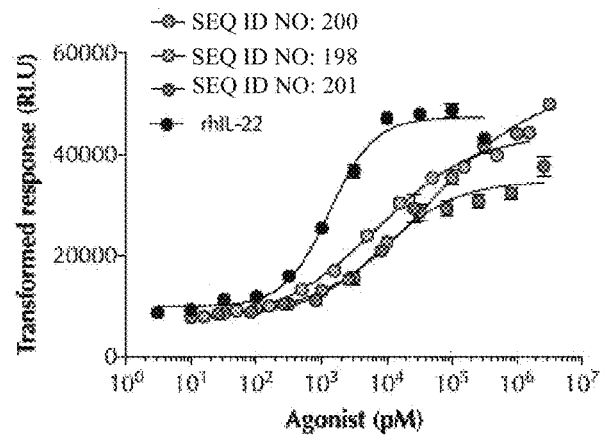

FIG. 28B shows that coupling of the IL-22 payload (SEQ ID NO: 142) to the N- or to the C-terminus of a carrier comprising amino acid residues 1-266 of SEQ ID NO: 1 via the spacer with SEQ ID NO: 196 did not significantly change the ability of the delivery constructs with SEQ ID NOs: 198, 200, and 201 to induce IL-22 receptor dimerization. The induction of receptor dimerization of control recombinant human IL-22 (rhIL-22) is shown by the black curve.

Figure 28C:
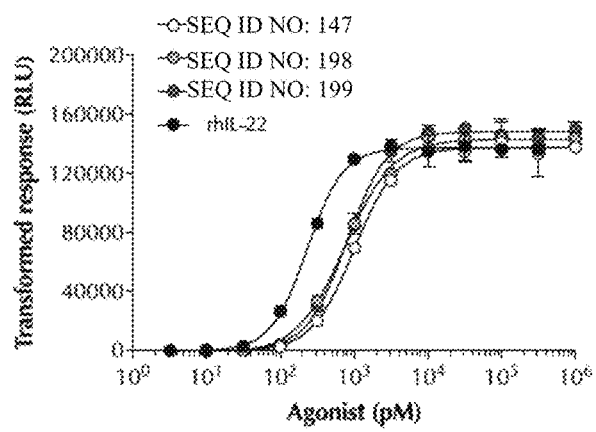

FIG. 28C shows that the length of amino acid spacers with SEQ ID NOs: 175, 196, and 197 did not impact the ability of IL-22 (SEQ ID NO: 142) when included in the delivery constructs with SEQ ID NOs: 147, 198, and 199 to induce pSTAT3 activation. The pSTAT3 activation of control recombinant human IL-22 (rhIL-22, SEQ ID NO: 143) is shown by the black curve.

Figure 28D:
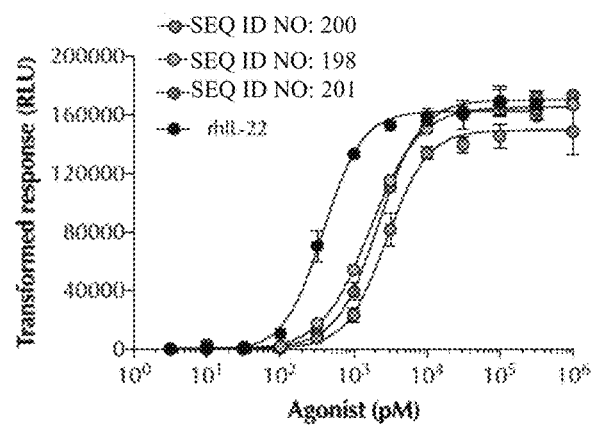

FIG. 28D shows that coupling of the IL-22 payload (SEQ ID NO: 142) to the N- or to the C-terminus of a carrier comprising amino acid residues 1-266 of SEQ ID NO: 1 via the spacer with SEQ ID NO: 196 did not significantly change the ability of the delivery constructs with SEQ ID NOs: 198, 200, and 201 to induce pSTAT3 activation. The pSTAT3 activation of control recombinant human IL-22 (rhIL-22) is shown by the black curve.

DETAILED DESCRIPTION

I. Introduction

Provided herein, in certain embodiments, are delivery constructs (e.g., carrier-payload complex) capable of transporting one or more heterologous payload molecules (e.g., one or more therapeutic payloads) into epithelial cells (e.g., polarized gut epithelial cells), e.g., by endocytosis, or across epithelial cells (e.g., polarized gut epithelial cells) by, e.g., by transcytosis. The delivery constructs can comprise a carrier that is coupled to the heterologous payload. The carrier can be capable of transporting the heterologous payload into or across epithelial cells using endogenous trafficking pathways. Utilization of endogenous trafficking pathways, as opposed to use of passive diffusion, can allow the carrier to shuttle the heterologous payload rapidly (e.g., at least $10^{-6}$ cm/sec, $10^{-5}$ cm/sec) and efficiently (e.g., at least 5%, 10%, 20%, 25%, or 50% of material applied to the apical surface) into or across epithelial cells without impairing the barrier function of these cells or the biological activity of the heterologous payload.

II. Carriers

The carrier portion of a delivery construct provided herein can be any molecule (e.g., small molecule, polypeptide, nucleic acid, etc.) capable of increasing the rate and/or amount of a heterologous payload (e.g., a therapeutic payload) delivered into and/or across an epithelium.

A carrier herein can have numerous attributes. In some embodiments, a carrier herein can have a reduced (e.g., at least 50% reduced) or ablated ADP ribosylation activity (e.g., ribosylation of elongation factor 2) relative to a naturally occurring Cholix polypeptide such as SEQ ID NO: 3.

In some embodiments, a carrier herein utilizes an endogenous trafficking pathway to transport a heterologous payload coupled thereto across a polarized epithelial cell. Such carrier can be referred to herein as a transcytosing carrier. In some instances, a carrier herein can utilize an endogenous trafficking pathway to transport a heterologous payload coupled thereto into a polarized epithelial cell. Such carrier can be referred to herein as an endocytosing carrier. Within endocytosing carriers, there can be carriers that deliver a payload coupled thereto into specific regions within the polarized epithelial cells such as an apical compartment, a supranuclear compartment, or a basal compartment.

Any of the carriers herein can transport molecules coupled thereto by interacting and/or co-localizing with one or more endogenous proteins of such epithelium. The one or more endogenous proteins can be receptors or enzymes capable of moving a carrier into or across the epithelial cell. Interacting and/or co-localizing with the one or more endogenous proteins of the epithelial cell can provide a carrier with one or more functions, including endocytosis into the epithelial cell, avoidance of a lysosomal destruction pathway, trafficking from an apical compartment to a basal compartment, and/or exocytosis from the basal membrane of the epithelial cell into a submucosal compartment such as the lamina propria.

An interaction of such carrier with an endogenous protein can be a selective interaction. Such selective interaction can be a pH-dependent interaction. In instances where a carrier interacts with two or more endogenous proteins, such interactions can be sequential interactions where a first interacting protein hands the carrier off to a second interacting protein. Such sequential interactions can occur at a different pH (e.g., pH 5.5, 7.0, 7.5, etc.). An interaction between a carrier and an endogenous protein can be a covalent or non-covalent interaction. Non-covalent interactions include hydrogen bonding, van der Waals interactions, ionic bonds, $\pi$-$\pi$-interactions, etc.

In some instances, one of the endogenous proteins that a carrier can interact with can be an apical entry receptor. Such apical entry receptor can be a transmembrane protein 132 (TMEM132). Interaction of a carrier with such apical entry receptor can enable the carrier to enter the epithelial cell through receptor-mediated endocytosis.

A carrier can also interact with a lysosome avoidance receptor. Such interaction with a lysosome avoidance receptor can occur inside the epithelial cell and subsequent to endocytosis. A lysosome avoidance receptor can be a glucose-regulated protein 75 (GRP75, e.g., GRP75B). Interaction of a carrier with such lysosome avoidance receptor can enable the carrier to avoid or circumvent lysosomal degradation. Such ability can allow a carrier to significantly reduce the amount of payload coupled to the carrier reaching a lysosome of a cell, a fate that most therapeutic proteins face once taken up by the gut epithelium.

Furthermore, a carrier can interact with an apical to basal trafficking protein. Such interaction can occur inside the epithelial cell and subsequent to endocytosis. Such apical to basal trafficking protein can be an endoplasmic reticulum Golgi intermediate compartment (ERGIC) protein, such as ERGIC-53. Interaction of a carrier with an ERGIC protein can enable the carrier to move from an apical compartment to a supranuclear compartment or a basal compartment.

A transcytosing carrier can also interact with a basal release protein capable of promoting exocytosis of a carrier from a basal site of an epithelial cell. Such interaction can occur at the basal site of an epithelial cell and subsequent to moving from an apical compartment to a basal compartment. Such basal release protein can be perlecan (also referred to herein as basement membrane-specific heparan sulfate proteoglycan core protein or HSPG). Interaction of a carrier with perlecan can enable the carrier to access a basal recycling system that allows release of the carrier from the basal compartment into a submucosal compartment such as the lamina propria.

Thus, a transcytosing carrier herein can be a molecule that is capable of interacting with the endogenous proteins TMEM132 (e.g., TMEM132A), GRP75 (e.g., GRP75B), ERGIC (e.g., ERGIC-53), and perlecan (HSPG), enabling such carrier to transport a payload molecule coupled thereto across a polarized epithelium, e.g., a polarized gut epithelium.

An endocytosing carrier herein can be a molecule that is capable of interacting with the endogenous protein TMEM132, allowing apical entry of such carrier. An endocytosing carrier can remain associated with TMEM132 after endocytosis (e.g., compared to a transcytosing carrier that can dissociate from TMEM132 after endocytosis to interact with, e.g., GRP75 or an ERGIC protein) and within apical regions and compartments of the cell (e.g., a polarized epithelial cell). In some cases, such endocytosing carrier can also interact with GRP75. Such interactions with TMEM132 and/or GRP75 can allow the carrier and a payload coupled thereto to avoid, or at least significantly reduce (e.g., less than about 50% compared to the payload molecule when it is not coupled to the carrier), lysosomal degradation. In some instances, an endocytosing carrier can remain in an apical compartment, and not show significant translocation to a basal compartment, for, e.g., at least about 5, 10, 15, 30, 60, or 120 minutes after apical (e.g., luminal) application of the carrier compared to a transcytosing carrier that can show complete transcytosis of nearly all apically applied molecules, e.g., about 5, 10, 15 or 30 minutes after apical (e.g., luminal) application. In some instances, at least about 50%, 75%, or 90% of carrier molecules remain in apical compartments 5 minutes after luminal application of the carrier. In some instances, at least about 50%, 75%, or 90% of carrier molecules remain in apical compartments 10 minutes after luminal application of the carrier. In some instances, at least about 50%, 75%, or 90% of carrier molecules remain in apical compartments 15 minutes after luminal application of the carrier. In some instances, at least about 50%, 75%, or 90% of carrier molecules remain in apical compartments 30 minutes after luminal application of the carrier. The percentage of carrier molecules that remain in the apical compartment of the epithelial cell can be determined by dividing the intensity of the fluorescence signal measured in a basal compartment of the cell by the intensity of the fluorescence signal measured in the apical compartment of the cell at the respective time point.

In other instances, an endocytosing carrier that is capable of transporting a payload to a supranuclear or basal compartment can interact with an ERGIC protein and/or another ER-Golgi trafficking protein complex that can allow the carrier to access such compartments inside an epithelial cell.

An endocytosing or transcytosing carrier can be a polypeptide. Such carrier can be derived from a polypeptide secreted by a bacterium, such as *Vibrio cholerae* (herein a Cholix derived polypeptide). A carrier can be a chimeric polypeptide derived from two or more different bacterial polypeptides. Such two or more different bacterial polypeptides can be derived from two or more different bacteria (e.g., *Vibrio cholerae, Pseudomonas aeruginosa*, etc.), and/or derived from two or more different strains of a bacterium (e.g., two or more different strains of *Vibrio cholerae, Pseudomonas aeruginosa*, etc.).

A carrier can be a naturally or non-naturally occurring polypeptide of a polypeptide secreted by such bacterium.

Non-naturally occurring polypeptides can include those having a C- and/or an N-terminal modification.

In one example, a polypeptide comprises one or more amino acid substitutions, and/or one or more amino acid deletions, and/or one or more amino acid additions relative to a sequence alignment with a naturally occurring polypeptide (e.g., SEQ ID NO: 3) or relative to a sequence alignment with a consensus sequence (e.g., SEQ ID NO: 130).

Examples of substitutions contemplated herein include conservative substitutions of one or more amino acids. The following six groups each contain amino acids that are conservative substitutions for one another: (1) Alanine (A), Serine (S), and Threonine (T); (2) Aspartic acid (D) and Glutamic acid (E); (3) Asparagine (N) and Glutamine (Q); (4) Arginine (R) and Lysine (K); (5) Isoleucine (I), Leucine (L), Methionine (M), and Valine (V); and (6) Phenylalanine (F), Tyrosine (Y), and Tryptophan (W).

Additionally, or alternatively, mutations in a carrier contemplated herein include one or more of: V1L, L1V, D3E, E4A, E581A, etc., e.g., relative to the sequence set forth in SEQ ID NOs: 1, 2, or 130 (a number designates the amino acid position, a letter before the number designates the modified amino acid, and a letter after the number designate the substituted amino acid). In some cases, a carrier comprises a valine at position 1, a leucine at position 1, an aspartic acid at position 3, a glutamic acid at position 3, a glutamic acid at position 4, or an alanine at position 4 in the carrier (numbering relative to positions in SEQ ID NO: 1).

Examples of deletions include N-terminal truncations and C-terminal truncations.

As used herein, when a C-terminal truncation is referred to as occurring "at" an amino acid position, such amino acid is included in the truncated polypeptide. When an N-terminal truncation is referred to as occurring "at" an amino acid position, such amino acid is excluded from the truncated polypeptide. For example, in one instance, the carrier comprises SEQ ID NO: 1 with a C-terminal truncation at position 386. Such carrier ends at amino acid 386 (A) of SEQ ID NO: 1 at its C terminus. Additionally, the above carrier can be further truncated at position 20 at its N-terminus, thereby having an N-terminal amino acid of proline (P) (which is position 21 in the reference sequence of SEQ ID NO: 1).

N-terminal truncations include those that remove up to 10, 20, 30, 39, or 40 amino acids at the N-terminal of a Cholix sequence herein (e.g., any one of SEQ ID NOs: 1-3, or 130). C-terminal truncations can be those described herein. Such N- and/or C-terminal truncations can result in different functions. Truncations can be described as relative to a wild-type sequence (e.g., SEQ ID NO: 3), relative to a non-naturally occurring sequence (e.g., SEQ ID NO: 1), or relative to a consensus sequence (e.g., SEQ ID NO: 130), wherein the residues are numbered from the N-terminus to the C-terminus, starting with position 1 an the N-terminus. For example, a carrier with a C-terminal truncation at position 266 relative to SEQ ID NO: 1 comprises amino acid residues 1-266 of SEQ ID NO: 1.

Examples of additions include: a signal peptide sequence, a purification peptide sequence, or other N-terminal modifications. A signal peptide sequence can comprise 1 to about 40 amino acids. In some cases, a carrier comprises an N-terminal methionine. The term "about," as used herein in the context of a numerical value or range, generally refers to ±10%, 9%, 8%, 7%, 6%, 5%, 4%, 3%, 2%, or 1% of the numerical value or range recited or claimed, unless otherwise specified.

A carrier can have a substantial sequence identity (e.g., about, or greater than, 50%, 60%, 70%, 80%, 90%, 95%, 98% or 99% sequence identity, or 100% sequence identity) to a naturally occurring polypeptide (e.g., SEQ ID NO: 3), a non-naturally occurring polypeptide (e.g., SEQ ID NOs: 1-2), or to any of the functional fragments described herein (e.g., SEQ ID NOs: 160-168).

The term "sequence identity" or a percent (%) of sequence identity, as used herein is the percentage of residues in a candidate sequence that are identical with the residues in a selected sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN, ALIGN-2 or Megalign (DNASTAR) software. Those skilled in the art can determine appropriate parameters for measuring alignment, including any algorithms needed to achieve maximal alignment over the full-length of the sequences being compared.

A carrier (e.g., an endocytosing or a transcytosing carrier) herein can be derived from a polypeptide secreted from a *Vibrio cholerae* bacterium (e.g., those comprising a sequence of any one of SEQ ID NOs: 3-125 or 127-129). Such carrier can be referred to as a Cholix derived polypeptide. A carrier derived from a Cholix polypeptide can include naturally and non-naturally occurring Cholix polypeptide sequences, as well as those sequences that have at least about 75%, 80%, 85%, 90%, 95%, 98%, 99%, or 100% sequence identity to a naturally (e.g., SEQ ID NO: 3-78) or non-naturally (e.g., SEQ ID NO: 1-2) occurring Cholix polypeptide described herein. A Cholix polypeptide derived carrier can also include endocytosing and/or transcytosing fragments (e.g., N- and/or C-terminal truncations of Cholix polypeptide) of naturally and non-naturally occurring Cholix polypeptide sequences, wherein such endocytosing and/or transcytosing fragments can have at least about 75%, 80%, 85%, 90%, 95%, 98%, 99%, or 100% sequence identity to any of such naturally or non-naturally occurring Cholix polypeptide sequences.

TABLE 1 provides exemplary full-length Cholix and Cholix derived sequences.

TABLE 1

Exemplary Cholix Polypeptide Sequences

| SEQ ID NO | Amino Acid Sequence | Description |
|---|---|---|
| SEQ ID NO: 1 | VEEALNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Non-naturally occuring Cholix polypeptide |
| SEQ ID NO: 2 | LEEALNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Non-Naturally occurring Cholix polypeptide |
| SEQ ID NO: 3 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |
| SEQ ID NO: 4 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWENQGNVSFA VTRPEQSIAKQSIAKQSIAISWPSVSYKAAQKEGSRHKRWAH WHTGLALCWLVPIDAIYNYITQQNCTLGDNWFGGSYETVAGT PKAITVKQGIEQKPVEQRIHFSKKNAMEALAAHRVCGVPLET LARSRKPRDLPDDLSCAYQAQNIVSLFVATRILFSHLDSVFT LNLDEQEPEVAERLSALRQINENNPGMVTQVLTVARQIYNDY VTHHPGLTPEQTSAGAQAADILSLFCPDADKPCVASNNDQAN INVESRSGRSYLPENRAVITPQGVTNWTYQELEATHQALTRE GYVFVGYHGTNHVAAQTIVNRIAPVPRGNNTENEEKWGGLYV ATHAEVAHGYARIKEGTGEYGLPTRAEREARGVMLRVYIPRA SLERFYRTNTPLENAERHITQVIGHSLPLRNEAFTGPESAGG EDETVIGWDMAIHAVAIPSTIPGNAYEELAIDEEAVAKEQSI SAKPPYKEQKDELK | Naturally occurring Cholix polypeptide |
| SEQ ID NO: 5 | VEDELNIFDECRSPCSLTPEPGKPIQSKLSIPSDVVLDEGVL YYSMTINDEQNDIMDEGKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWENQGNVSFA VTRPEQSIAKQSIAISWPSVSYKAAQKEGSRHKRWAHWHTGL ALCWLVPIDAIYNYITQQNCTLGDNWFGGSYETVAGTPKAIT VKQGIEQKPVEQRIHFSKKNAMEALAAHRVCGVPLETLARSR KPRDLTDDLSCAYQAQNIVSLFVATRILFSHLDSVFTLNLDE | Naturally occurring Cholix polypeptide |

TABLE 1-continued

Exemplary Cholix Polypeptide Sequences

| SEQ ID NO | Amino Acid Sequence | Description |
|---|---|---|
| | QEPEVAERLSALRQINENNPGMVTQVLTVARQIYNDYVTHHP GLTPEQTSAGAQAADILSLFCPDADKSCVASNNDQANINIES RSGRSYLPENRAVITPQGVTNWTYQELEATHQALTREGYVFV GYHGTNHVAAQTIVNRIAPVPRGNNTENEEKWGGLYVATHAE VAHGYARIKEGTGEYGLPTRAERDARGVMLRVYIPRASLERF YRTNTPLENAEEHITQVIGHSLPLRNEAFTGPESAGGEDETV IGWDMAIHAVAIPSTIPGNAYEELAIDEEAVAKEQSISTKPP YKERKDELK | |
| SEQ ID NO: 6 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL TDDLSCAYQAQNIVSLFVATRILFSHLDSVFTLNLDEQEPEV AERLSALRQINENNPGMVTQVLTVARQIYNDYVTHHPGLTPE QTSAGAQAADILSLFCPDADKPCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYERLTPAEEAVVKEAIAKEQSISAKPP YKEQKDELK | Naturally occurring Cholix polypeptide |
| SEQ ID NO: 7 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPEV AERLSALRQINENNPGMVTQVLTVARQIYNDYVTHHPGLTPE QTSAGAQAADILSLFCPDADKPCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYERLTPAEEAVVKEAIAKEQSISAKPP YKEQKDELK | Naturally occurring Cholix polypeptide |
| SEQ ID NO: 8 | VEDELNIFDECRSPCSLTPEPGKQIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL TDDLSCVYQAQNIVSLFVATRILFSHLDSVFTLNLDEQEPEV AERLSALRQINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEKKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |
| SEQ ID NO: 9 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISAKPPYKERK DELK | Naturally occurring Cholix polypeptide |

TABLE 1-continued

Exemplary Cholix Polypeptide Sequences

| SEQ ID NO | Amino Acid Sequence | Description |
|---|---|---|
| SEQ ID NO: 10 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVSTHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |
| SEQ ID NO: 11 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL TDDLSCVYQAQNIVSLFVATRILFSHLDSVFTLNLDEQEPEV AERLSALRQINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEKKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |
| SEQ ID NO: 12 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPEV AERLSALRQINENNPGMVTQVLTVARQIYNDYVTHHPGLTPE QTSAGAQAADILSLFCPDADKPCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIHRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |
| SEQ ID NO: 13 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPAV AERLSALRQINENNPGMVTQVLTVARQIYNDYVTHHPGLTPE QTSAGAQAADILSLFCPDADKSCVASDNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |
| SEQ ID NO: 14 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL | Naturally occurring Cholix polypeptide |

TABLE 1-continued

Exemplary Cholix Polypeptide Sequences

| SEQ ID NO | Amino Acid Sequence | Description |
|---|---|---|
| | PDDLSCAYQAQNIVSLFVATRILFSHLDSVFTLNLDEQEPEV AERLSALRQINENNPGMVTQVLTVARQIYNDYVTHHPGLIPE QTSAGAQAADILSLFCPDADKPCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAEREARGVMLRVYIPRASLERFYRTNT PLENAERHITQVIGHSLPLRNEAFTGPESAGGEDETVIGWDM AIHAVAIPSTIPGNAYEELAIDEEAVAKEQSISAKPPYKERK DELK | |
| SEQ ID NO: 15 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPEV AERLSALRQINENNPGMVTQVLTVARQIYNDYVTHHPGLIPE QTSAGAQAADILSLFCPDADKPCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAEREARGVMLRVYIPRASLERFYRTNT PLENAERHITQVIGHSLPLRNEAFTGPESAGGEDETVIGWDM AIHAVAIPSTIPGNAYEELAIDEEAVAKEQSISAKPPYKEQK DELK | Naturally occurring Cholix polypeptide |
| SEQ ID NO: 16 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRMLFSHLDSVFTLNLDEQEPEV AERLSALRQINENNPGMVTQVLTVARQIYNDYVTHHPGLIPE QTSAGAQAADILSLFCPDADKPCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAEREARGVMLRVYIPRASLERFYRTNT PLENAERHITQVIGHSLPLRNEAFTGPESAGGEDETVIGWDM AIHAVAIPSTIPGNAYEELAIDEEAVAKEQSISAKPPYKEQK DELK | Naturally occurring Cholix polypeptide |
| SEQ ID NO: 17 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPEV AERLSALRQINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARLKKGTGNAELPTRAERDARGVMLRVYIPRASLERFYRTNT PLENAEEHITHVIGHSLPLRNEAFTGPERVDGEDETVIGWDM AIHAVAIPSTIPGNAYEVLAIDEEAVAEEQSISAKPPYKERK DELK | Naturally occurring Cholix polypeptide |
| SEQ ID NO: 18 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVFFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPEV TERLSALRQINENNPGMVTQVLTVARQIYNDYVTHHPGLTPE QTSAGAQAADILSLFCPDADKPCVASNNDQANINIESRSGRS YLPENRAVITPQGVTNWTYQELEATHQALTREGYVFVGYHGT | Naturally occurring Cholix polypeptide |

TABLE 1-continued

Exemplary Cholix Polypeptide Sequences

| SEQ ID NO | Amino Acid Sequence | Description |
|---|---|---|
| | NHVAAQTIVNRIAPVPRGNNTENEEKWGGLYVATHAEVAHGY ARIKEGTGEYGLPTRAERDARGVMLRVYIHRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | |
| SEQ ID NO: 19 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPAV AERLSALRQINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISAKPPYKERK DELK | Naturally occurring Cholix polypeptide |
| SEQ ID NO: 20 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPAV AERLSALRQINENNPGMVTQVLTVARQIYNDYVTHHPGLTPE QTSAGAQAADILSLFCPDADKSCVALNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISAKPPYKERK DELK | Naturally occurring Cholix polypeptide |
| SEQ ID NO: 21 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL TDDLSCAYQAQNIVSLFVATRILFSHLDSVFTLNLDEQAPEV AERLSALRQINENNPGVVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGNGGLPTRAERETRGVMLRVYIPRASLERFYRTNT PLENAEEHITQVIGHSLPLRNEAFTGPESAGGEDETVIGWDM AIHAVAIPSTIPGNAYEELAIDEEAVAKEQSISAKPPYKEQK DELK | Naturally occurring Cholix polypeptide |
| SEQ ID NO: 22 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKTVEQRIHFSKKNAMEALAAHRVCGVPLETLARSRKPRDL TDDLSCVYQAQNIVSLFVATRILFSHLDSVFTLNLEEQEPEV AERLSALRQINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGNGGLPTRAERETRGVMLRVYIPRASLERFYRTNT PLENAEEHITDVIGHSLPLRNEAFTGPESAGGEDETVIGWDM AIHAVAIPSTIPGNAYEELAIDEEAVAKEQSISAKPPYKEQK DELK | Naturally occurring Cholix polypeptide |
| SEQ ID NO: 23 | VEDELNIFDECRSPCSLTPEPGKPIQSKLSIPSDVVLDEGVL YYSMTINDEQNDIKDEDKGESIITIGEFATVRATRHYVNQDA | Naturally occurring |

TABLE 1-continued

Exemplary Cholix Polypeptide Sequences

| SEQ ID NO | Amino Acid Sequence | Description |
|---|---|---|
| | PFGVINLDITTENGTKTYSYNRKEGEFAINWLVPIGEDSPAS<br>IKISVDELDQQRNIIEVPKLYSIDLDNQTLEQWENQGNVSFS<br>VTRPEHNIAISWPSVSYKAAQKEGSRHKRWAHWHTGLALCWL<br>VPIDAIYNYITQQNCTLGDNWFGGSYETVAGTPKAIMVKQGI<br>EQKPVEQRIHFSKKNAMEALAAHRVCGVPLETLARSRKPRYL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKSCVASNNDQANINIESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPERVDGEDETVIGWDM<br>AIHAVAIPSTIPGNAYEELAIDEEAVAKEQSISPKPPYKERK<br>DELK | Cholix<br>polypeptide |
| SEQ ID NO: 24 | VEDELNIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKDGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPAV<br>AERLSAIRQINENNPGMVTQVLTVARQIYNDYVTHHPGLTPE<br>QTSAGAQAADILSLFCPDADKSCVASDNDQANINIESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDM<br>AIHAVAIPSTIPGNAYEELAIDEEAVAKEQSISTKPPYKERK<br>DELK | Naturally<br>occurring<br>Cholix<br>polypeptide |
| SEQ ID NO: 25 | VEDELNIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKDGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKHCVASNNDQANINVESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAERHITQVIGHSLPLRNEAFTGPESAGGEDETVIGWDM<br>AIHAVAIPSTIPGNAYEELAIDEEAVAKEQSISAKPPYKERK<br>DELK | Naturally<br>occurring<br>Cholix<br>polypeptide |
| SEQ ID NO: 26 | VEDELNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWRTGLALCWL<br>VPMDAIYNYITQQNCTLGDNWFGGSYETVAGTPKVITVKQGI<br>EQKPVEQRIHFSKGNAMSALAAHRVCGVPLETLARSRKPRDL<br>TDDLSCAYQAQNIVSLFVATRILFSHLDSVFTLNLEEQEPEV<br>AERLSALRQINENNPGMVTQVLTVARQIYNDYVTHHPGLTPE<br>QTSAGAQAADILSLFCPDADKSCVASNNDQANINIESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDM<br>AIHAVAIPSTIPGNAYEELAIDEEAVAKEQSISTKPPYKERK<br>DELK | Naturally<br>occurring<br>Cholix<br>polypeptide |
| SEQ ID NO: 27 | VEDELNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPMDAIYNYITQQNCTLGDNWFGGSYETVAGTPKVITVKQGI<br>EQKPVEQRIHFSNGNAMSALAAHRVCGVPLETLARSRKPRDL<br>TDDLSCAYQAQNIVSLFVATRILFSHLDSVFTLNLDEQEPEV<br>AERLSDLRRINENNPGMVTQVLTVARQIYNDYVTHHPGLTPE<br>QTSAGAQAADILSLFCPDADKSCVASNNDQANINIESRSGRS | Naturally<br>occurring<br>Cholix<br>polypeptide |

TABLE 1-continued

Exemplary Cholix Polypeptide Sequences

| SEQ ID NO | Amino Acid Sequence | Description |
|---|---|---|
| | YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDM<br>AIHAVAIPSTIPGNAYEELAIDEEAVAKEQSISTKPPYKERK<br>DELK | |
| SEQ ID NO: 28 | VEDELNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPMDAIYNYITQQNCTLGDNWFGGSYETVAGTPKVITVKQGI<br>EQKPVEQRIHFSKGNAMSALAAHRVCGVPLETLARSRKPRDL<br>TDDLSCAYQAQNIVSLFVATRILFSHLDSVFTLNLDEQEPEV<br>AERLSDLRRINENNPGMVTQVLTVARQIYNDYVTHHPGLTPE<br>QTSAGAQAADILSLFCPDADKSCVASNNDQANINIESRSGRS<br>YLLENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDM<br>AIHAVAIPSTIPGNAYEELAIDEEAVAKEQSISTKPPYKERK<br>DELK | Naturally<br>occurring<br>Cholix<br>polypeptide |
| SEQ ID NO: 29 | VEDELNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPMDAIYNYITQKNCTLGDNWFGGSYETVAGTPKVITVKQGI<br>EQKPVEQRIHFSKGNAMSALAAHRVCGVPLETLARSRKPRDL<br>PDDLSCAYQAQNIVSLFVATRILFSHLDSVFTLNLDEQEPEV<br>AERLSDLRRINENNPGMVTQVLTVARQIYNDYVTHHPGLTPE<br>QTSAGAQAADILSLFCPDADKSCVASNNDQANINIESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDM<br>AIHAVAIPSTIPGNAYEELAIDEEAVAKEQSISAKPPYKEQK<br>DELK | Naturally<br>occurring<br>Cholix<br>polypeptide |
| SEQ ID NO: 30 | VEDELNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKSCVASNNDQANINIESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDM<br>AIYAVAIPSTIPGNAYEELAIDEEAVAKEQSISAKPPYKEQK<br>DELK | Naturally<br>occurring<br>Cholix<br>polypeptide |
| SEQ ID NO: 31 | VEDELNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPAV<br>AERLSALRQINENNPGMVTQVLTVARQIYNDYVTHHPGLTPE<br>QTSAGAQAADILSLFCPDADKPCVASNNDQANINVESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAEREARGVMLRVYIPRASLERFYRTNT<br>PLENAERHITQVIGHSLPLRNEAFTGPESAGGEDETVIGWDM<br>AIHAVAIPSTIPGNAYEELAIDEEAVAKEQSISAKPPYKEQK<br>DELK | Naturally<br>occurring<br>Cholix<br>polypeptide |

TABLE 1-continued

Exemplary Cholix Polypeptide Sequences

| SEQ ID NO | Amino Acid Sequence | Description |
|---|---|---|
| SEQ ID NO: 32 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIYAVAIPSTIPGNAYEELAIDEEAVAKEQSISAKPPYKEQK DELK | Naturally occurring Cholix polypeptide |
| SEQ ID NO: 33 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPMDAIYNYITQKNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |
| SEQ ID NO: 34 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKTVEQRIHFSKKNAMEALAAHRVCGVPLETLARSRKPRDL TDDLSCVYQAQNIVSLFVATRILFSHLDSVFTLNLEEQEPEV AERLSALRQINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPERVDGEDETVIGWDM AIHAVAIPSTIPGNAYEELAIDEEAVAKEQSISTKPPYKERK DELK | Naturally occurring Cholix polypeptide |
| SEQ ID NO: 35 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPEV AERLSALRQINENNPGMVTQVLTVARQIYNDYVTHHPGLTPE QTSAGAQAADILSLFCPDADKPCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGNGGLPTRAERETRGVMLRVYIPRASLERFYRTNT PLENAEEHITDVIGHSLPLRNEAFTGPESAGGEDETVIGWDM AIHAVAIPSTIPGNAYEELAIDEEAVAKEQSISAKPPYKEQK DELK | Naturally occurring Cholix polypeptide |
| SEQ ID NO: 36 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAIHWLVPIGEDSPAS IKISVDELDQQRNIIEVPKLYSIDLDNQTLEQWENQGNVSFS VTRPEHNIAISWPSVSYKAAQKEGSRHKRWAHWHTGLALCWL VPIDAIYNYITQQNCTLGDNWFGGSYETVAGTPKAITVKQGI EQKTVEQRIHFSKKNAMEALAAHRVCGVPLETLARSRKPRDL TDDLSCVYQAQNIVSLFVATRILFSHLDSVFTLNLEEQEPEV | Naturally occurring Cholix polypeptide |

TABLE 1-continued

Exemplary Cholix Polypeptide Sequences

| SEQ ID NO | Amino Acid Sequence | Description |
|---|---|---|
| | AERLSALRQINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | |
| SEQ ID NO: 37 | VEDELNIFDECRSPCSLTPEPGKPIQSKLSIPSDVVLDEGVL YYSMTINDEQNDIKDEDKGESIITIGEFATIRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAERHITQVIGHSLPLRNEAFTGPESAGGEDETVIGWDM AIHAVAIPSTIPGNAYEELAIDEEAVAKEQSISAKPPYKEQK DELK | Naturally occurring Cholix polypeptide |
| SEQ ID NO: 38 | VEDELNIFDECRSPCSLTPEPGKPIQSKLSIPSDVVLDEGVL YYSMTINDEQNDIKDEDKGESIITFGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |
| SEQ ID NO: 39 | VEDELNIFDECRSPCSLTPEPGKPIQSKLSIPGDVVLDEGVL YYSMTINDEQNDIKDEDKGESIITIGEFATVRATRHYVSQDA PFGVINLDITTENGTKTYSFNRKESEFAINWLVPIGEDSPAS IKISIDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYNAQQIVSLFLATRILFTHIDSIFTLNLDGQEPEV AERLDDLRRINENNPGMVIQVLTVARQIYNDYVTHHPGLTPE QTSAGAQAADILSLFCPDADKSCVASNSDQANINIESRSGRS YLPENRAVITQQGVTNWTYQELEATHQALTQEGYVFVGYHGT NHVAAQSIVNRISPVPRGSDTESERAWGGLYVSTDASVAYGY ARIQEGTADGGGLTPAERKARGVMLRVYLPQASLERFYRINA DLEKERNLVERVIGHPLPLRNEAFTGTDAEEGSDETAIGWDM AIHGVAIPSTIPGNSYAQLPIDEEAVAKEQSISAKPPYKEQK DELK | Naturally occurring Cholix polypeptide |
| SEQ ID NO: 40 | VEDELNIFDECRSPCSLTPELGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYQAQNIVSLFVATRILFSHLDSVFTLNLDEQEPEV AERLSALRQINENNPGMVTQVLTVARQIYNDYVTHHPGLTPE QTSAGAQAADILSLFCPDADKPCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDETVIGWDM AIHAVAIPSTIPGNAYEELAIDEEAVAKEQSISTKPPYKERK DELK | Naturally occurring Cholix polypeptide |

TABLE 1-continued

Exemplary Cholix Polypeptide Sequences

| SEQ ID NO | Amino Acid Sequence | Description |
|---|---|---|
| SEQ ID NO: 41 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPAV<br>AERLSALRQINENNPGMVTQVLTVARQIYNDYVTHHPGLTPE<br>QTSAGAQAADILSLFCPDADKSCVASDNDQANINIESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDM<br>AIHAVAIPSTIPGNAYEELAIDEEAVAKEQSISTKPPYKERK<br>DELK | Naturally<br>occurring<br>Cholix<br>polypeptide |
| SEQ ID NO: 42 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKPCVASNNDQANINIESRSGRS<br>YLPENRAVITPQGVTNWTYQELEATHQALTREGYVFVGYHGT<br>NHVAAQNIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDM<br>AIHAVAIPSTIPGNAYEELAIDEEAVAKEQSISTKPPYKERK<br>DELK | Naturally<br>occurring<br>Cholix<br>polypeptide |
| SEQ ID NO: 43 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKPCVASNNDQANINIESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAERDARGVMLRVYIPRASLERFYRTNT<br>PLENAEEHITQVIGHSLPLRNEAFTGPESAGGEDETVIGWDI<br>AIHAVAIPSTIPGNAYEELAIDEEAVAKEQSISTKPPYKERK<br>DELK | Naturally<br>occurring<br>Cholix<br>polypeptide |
| SEQ ID NO: 44 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKPCVASNNDQANINVESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAEREARGVMLRVYIPRASLERFYRTNT<br>PLENAERHITQVIGHSLPLRNEAFTGPESAGGEDETVIGWDM<br>AIHAVAIPSTIPGNAYEELAIDEEAVAKEQSISAKPPYKERK<br>DELK | Naturally<br>occurring<br>Cholix<br>polypeptide |
| SEQ ID NO: 45 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMETLAAHRVCGVPLETLARSRKPRDL<br>PDDLSCAYQAQNIVSLFVATRILFSHLDSVFTLNLDEQEPEV | Naturally<br>occurring<br>Cholix<br>polypeptide |

TABLE 1-continued

Exemplary Cholix Polypeptide Sequences

| SEQ ID NO | Amino Acid Sequence | Description |
|---|---|---|
|  | AERLSALRQINENNPGMVTQVLTVARQIYNDYVTHHPGLTPE<br>QTSAGAQAADILSLFCPDADKPCVASNNDQANINVESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAEREARGVMLRVYIPRASLERFYRTNT<br>PLENAERHITQVIGHSLPLRNEAFTGPESAGGEDETVIGWDM<br>AIHAVAIPSTIPGNAYEELAIDEEAVAKEQSISAKPPYKERK<br>DELK |  |
| SEQ ID NO: 46 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKPCVASNNDQANINVESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAEREARGVMLRVYIPRASLERFYRTNT<br>PLENAERHITQVIGHSLPLRNEAFTGPESAGGEDETVIGWDM<br>AIHAVAIPSTIPGNAYEELAIDEEAVAKEQSISAKPPYKEQK<br>DELK | Naturally<br>occurring<br>Cholix<br>polypeptide |
| SEQ ID NO: 47 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMETLAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKPCVASNNDQANINVESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAEREARGVMLRVYIPRASLERFYRTNT<br>PLENAERHITQVIGHSLPLRNEAFTGPESAGGEDETVIGWDM<br>AIHAVAIPSTIPGNAYEELAIDEEAVAKEQSISAKPPYKEQK<br>DELK | Naturally<br>occurring<br>Cholix<br>polypeptide |
| SEQ ID NO: 48 | VEDELNIFDECRSPCLLTPEPGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWENQGNVSFA<br>VTRPEQSIAISWPSVSYKAAHKNGSRHKRWAHWHTGLALCWL<br>VPIDAIYNYITQQNCTLGDNWFGGSYETVAGTPKAITVKQGI<br>EQKPVEQRIHFSKKNAMEALAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKPCVASNNDQANINVESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAEREARGVMLRVYIPRASLERFYRTNT<br>PLENAERHITQVIGHSLPLRNEAFTGPESAGGEDETVIGWDM<br>AIHAVAIPSTIPGNAYEELAIDEEAVAKEQSISAKPPYKEQK<br>DELK | Naturally<br>occurring<br>Cholix<br>polypeptide |
| SEQ ID NO: 49 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVIPGEDSPAS<br>IKISVDELDQQRNIIEVPKLYSIDLDNQTLEQWKTQGNVSFS<br>VTRPEHNIAISWPSVSYKAAQKEGSRHKRWAHWHTGLALCWL<br>VPIDAIYNYITQQNCTLGDNWFGGSYETVAGTPKAITVKQGI<br>EQKPVEQRIHFSKKNAMETLAAHRVCGVPLETLARSRKPRDL<br>PDDLSCAYQAQNIVSLFVATRILFSHLDSVFTLNLDEQEPEV<br>AERLSALRQINENNPGMVTQVLTVARQIYNDYVTHHPGLTPE<br>QTSAGAQAADILSLFCPDADKPCVASNNDQANINVESRSGRS<br>YLPENRAVITPQGVTNWTYQELEATHQALTREGYVFVGYHGT<br>NHVAAQTIVNRIAPVPRGNNTENEEKWGGLYVATHAEVAHGY<br>ARIKEGTGEYGLPTRAEREARGVMLRVYIPRASLERFYRTNT<br>PLENAERHITQVIGHSLPLRNEAFTGPESAGGEDETVIGWDM<br>AIHAVAIPSTIPGNAYEELAIDEEAVAKEQSISAKPPYKERK<br>DELK | Naturally<br>occurring<br>Cholix<br>polypeptide |

TABLE 1-continued

Exemplary Cholix Polypeptide Sequences

| SEQ ID NO | Amino Acid Sequence | Description |
| --- | --- | --- |
| SEQ ID NO: 50 | VEDELNIFDECRSPCSLTPEPGKPIQSKLSIPSDVVLDEGVL YYSMTINDEQNDIKDEDKGESIITIGEFATVRATRHYVSQDA PFGVINLDITTENGTKTYSFNRKESEFAINWLVPIGEDSPAS IKISVDELDQQRNIIEVPKLYSIDLDNQTLEQWETQGNVSFA VTRPEQSIAISWPSVSYKAAHKNGSRHKRWANWFTTSPKVTL CFYEDPAQCTYGDDWHGGAYKTVAGTPKAITVKQGIEQKTVE QRIHFSKKNAMEALAAHRVCGVPLETLARSRKPRDLPDDLSC AYQAQNIVSLFVATRILFSHLDSVFTLNLDEQEPEVAERLSA LRQINENNPGMVTQVLTVARQIYNDYVTHHPGLTPEQTSAGA QAADILSLFCPDADKSCVASNNDQANINIESRSGRSYLPENR AVITPQGVTNWTYQELEATHQALTREDYVFVGYHGTNHVAAQ TIVNRIAPVPRGNNTENEEKWGGLYVATHAEVAHGYARIKEG TGEYGLPTRAEQETRGVMLRVYIPRASLERFYRTNTPLENAE EHITQVIGHSLPLRNEAFTGPESAGGEDETVIGWDMAIHAVA IPSTIPGNAYEGLTTDEEAVVKEAIAKEQSISAKPPYKERKD ELK | Naturally occurring Cholix polypeptide |
| SEQ ID NO: 51 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWENQGNVSFA VTRPEQSIAISWPSVSYKAAHKNGSRHKRWANWFTTSPKVTL CFYEDPAQCTYGDDWHGGAYKTVAGTPKAITVKQGIEQKTVE QRIHFSQKNAMEALAAHRVCGVPLETLARSRKPRDLPDDLSC AYQAQNIVSLFVATRILFSHLDSVFTLNLDEQEPEVAERLSA LRQINENNPGMVTQVLTVARQIYNDYVTHHPGLTPEQTSAGA QAADILSLFCPDADKSCVASNNDQANINIESRSGRSYLPENR AVITPQGVTNWTYQELEATHQALTREDYVFVGYHGTNHVAAQ TIVNRIAPVPRGNNTENEEKWGGLYVATHAEVAHGYARIKEG TGEYGLPTRAEQETRGVMLRVYIPRASLERFYRTNTPLENAE EHITQVIGHSLPLRNEAFTGPESAGGEDETVIGWDMAIHAVA IPSTIPGNAYEGLTTDEEAVVKEAIAKEQSISAKPPYKEQKD ELK | Naturally occurring Cholix polypeptide |
| SEQ ID NO: 52 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDEIDQQRNIIEVPKLYSIDLDNQTLEQWENQGNVSFA VTRPEQSIAISWPSVSYKAAHKNGSRHKRWANWFTTSPKVTL CFYEDPAQCTYGDDWHGGAYKTVAGTPKAITVKQGIEQKTVE QRIHFSKKNAMEALAAHRVCGVPLETLARSRKPRDLPDDLSC AYQAQNIVSLFVATRILFSHLDSVFTLNLDEQEPEVAERLSA LRQINENNPGMVTQVLTVARQIYNDYVTHHPGLTPEQTSAGA QAADILSLFCPDADKSCVASNNDQANINIESRSGRSYLPENR AVITPQGVTNWTYQELEATHQALTREDYVFVGYHGTNHVAAQ TIVNRIAPVPRGNNTENEEKWGGLYVATHAEVAHGYARIKEG TGEYGLPTRAEQETRGVMLRVYIPRASLERFYRTNTPLENAE EHITQVIGHSLPLRNEAFTGPESAGGEDETVIGWDMAIHAVA IPSTIPGNAYEGLTTDEEAVVKEAIAKEQSISAKPPYKERKD ELK | Naturally occurring Cholix polypeptide |
| SEQ ID NO: 53 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDEIDQQRNIIEVPKLYSIDLDNQTLEQWENQGNVSFA VTRPEQSIAISWPSVSYKAAHKNGSRHKRWANWFTTSPKVTL CFYEDPAQCTYGDDWHGGAYKTVAGTPKAITVKQGIEQKTVE QRIHFSKKNAMEALAAHRVCGVPLETLARSRKPRDLPDDLSC AYQAQNIVSLFVATRILFSHLDSVFTLNLDEQEPEVAERLSA LRQINENNPGMVTQVLTVARQIYNDYVTHHPGLTPEQTSAGA QAADILSLFCPDADKSCVASNNDQANINIESRSGRSYLPENR AVITPQGVTNWTYQELEATHQALTREGYVFVGYHGTNHVAAQ TIVNRIAPVPRGNNTENEEKWGGLYVATHAEVAHGYARIKEG TGEYGLPTRAEQETRGVMLRVYIPRASLERFYRTNTPLENAE EHITQVIGHSLPLRNEAFTGPESAGGEDETVIGWDMAIHAVA IPSTIPGNAYEGLTTDEEAVVKEAIAKEQSISAKPPYKEQKD ELK | Naturally occurring Cholix polypeptide |
| SEQ ID NO: 54 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDEIDQQRNIIEVPKLYSIDLDNQTLEQWENQGNVSFA VTRPEQSIAISWPSVSYKAAHKNGSRHKRWANWFTTSPKVTL CFYEDPAQCTYGDDWHGGAYKTVAGTPKAITVKQGIEQKTVE QRIHFSKKNAMEALAAHRVCGVPLETLARSRKPRDLPDDLSC | Naturally occurring Cholix polypeptide |

TABLE 1-continued

Exemplary Cholix Polypeptide Sequences

| SEQ ID NO | Amino Acid Sequence | Description |
|---|---|---|
| | AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREDYVFVGYHGTNHVAAQ<br>TIVNRIAPVPRGNNTENEEKWGGLYVATHAEVAHGYARIKEG<br>TGEYGLPTRAEQETRGVMLRVYIPRASLERFYRTNTPLENAE<br>EHITQVIGHSLPLRNEAFTGPESAGGEDETVIGWDMAIHAVA<br>IPSTIPGNAYEGLTTDEEAVVKEAIAKEQSISAKPPYKEQKD<br>ELK | |
| SEQ ID NO: 55 | VEDELNIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDEIDQQRNIIEVPKLYSIDLDNQTLEQWENQGNVSFA<br>VTRPEQSIAISWPSVSYKAAHKNGSRHKRWANWFTTSPKVTL<br>CFYEDPAQCTYGDDWHGGAYKTVAGIPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREDYVFVGYHGTNHVAAQ<br>TIVNRIAPVPRGNNTENEEKWGGLYVATHAEVAHGYARIKEG<br>TGEYGLPTRAEQETRGVMLRVYIPRASLERFYRTNTPLENAE<br>EHITQVIGHSLPLRNEAFTGPESAGGEDETVIGWDMAIHAVA<br>IPSTIPGNAYEGLTTDEEAVVKEAIAKEQSISAKPPYKERKD<br>ELK | Naturally<br>occurring<br>Cholix<br>polypeptide |
| SEQ ID NO: 56 | VEDELNIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDEIDQQRNIIEVPKLYSIDLDNQTLEQWENQGNVSFA<br>VTRPEQSIAISWPSVSYKAAHKNGSRHKRWANWFTTSPKVTL<br>CFYEDPAQCTYGDDWHGGAYKTVAGIPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREDYVFVGYHGTNHVAAQ<br>TIVNRIAPVPRGNNTENEEKWGGLYVATHAEVAHGYARIKEG<br>TGEYGLPTRAEQETRGVMLRVYIPRASLERFYRTNTPLENAE<br>EHITQVIGHSLPLRNEAFTGPESAGGEDETVIGWDMAIHAVA<br>IPSTIPGNAYEGLTTDEEAVVKEAIAKEQSISAKPPYKEQKD<br>ELK | Naturally<br>occurring<br>Cholix<br>polypeptide |
| SEQ ID NO: 57 | VEDELNIFDECRSPCSLTPEPGKPIQSKLSIPGDVVLDEGVL<br>YYSMTINDEQNDIKDEDKGESIITIGEFATVRATRHYVSQDA<br>PFGVINLDITTENGTKTYSFNRKESEFAINWLVPIGEDSPAS<br>IKISIDELDQQRNIIEVPKLYSIDLDNQTLEQWENQGNVSFA<br>VTRPEQSIAISWPSVSYKAAHKNGSRHKRWANWLTTLPEVVL<br>CFFEDPELCTYGDDWHGGAYKTVAGTPKAITVKQGIEQKTVE<br>QRIHFSKKNAMEALAAHRVCGVPLETLARSRKPRDLPDDLSC<br>AYNAQQIVSLFLATRILFTHIDSIFTLNLDGQEPEVAERLDD<br>LRRINENNPGMVIQVLTVARQIYNDYVTHHPGLTPEQTSAGA<br>QAADILSLFCPDADKSCVASNSDQANINIESRSGRSYLPENR<br>AVITQQGVTNWTYQELEATHQALTQEGYVFVGYHGTNHVAAQ<br>TIVNRIAPVPRGNNTENEEKWGGLYVATHAEVAHGYARIKEG<br>TGEYGLPTRAEQETRGVMLRVYIPRASLERFYRTNTPLENAE<br>EHITQVIGHSLPLRNEAFTGPESAGGEDETVIGWDMAIHAVA<br>IPSTIPGNAYEGLTTDEEAVVKEAIAKEQSISAKPPYKEQKD<br>ELK | Naturally<br>occurring<br>Cholix<br>polypeptide |
| SEQ ID NO: 58 | VEDELNIFDECRSPCSLTPEPGKPIQSKLSIPGDVVLDEGVL<br>YYSMTINDEQNDIKDEDKGESIITIGEFATVRATRHYVNQDA<br>PFGVIHLDITTENGTKTYSFNRKEGEFAINWLVPIGEDSPAS<br>IKISIDELDQQRNIIEVPKLYSIDLDNQTLEQWETQGNVSFA<br>VTRPEQSIAISWPSVSYKAAQKDGARHKRWAHWHTGLALCWL<br>VPLDAIYNYITQQNCTLGDNWFGGSYETVAGTPKAITVKQGM<br>EQKPVEQRIHFSKKNAMEALAAHRVCGVPLETLARGRKPRDL<br>TDDLQCAYQAQNIVSLFLATRILFSHLDSVFTLNLDEQEPEV<br>AERLTDLRRINENNPGMVTQVLTIARQIYNDYVTEHPGLTPE<br>QTSAGAQAADILSLFCPDADESCVASNSDQANINIESRSGRS<br>YLPENRAVITPQGVTNWTYQELEAKHQTLTREGYVFVGYHGT | Naturally<br>occurring<br>Cholix<br>polypeptide |

TABLE 1-continued

Exemplary Cholix Polypeptide Sequences

| SEQ ID NO | Amino Acid Sequence | Description |
|---|---|---|
| | NHVAAQSIVNRITPVPRGNNTEKEEEWGGVYVATHAELAHRY ARIKEGTGENGLPTTEEKKSRGVMLRVYLPRASLERFYRTNI PLENADEHVTQVIGHPLPLRNEAFTGPESAGGEDETAIGWDM AIHGVAIPSTIPGNSYAQLPIDEEAVAKEQSISAKPPYKEH DELK | |
| SEQ ID NO: 59 | VEDELNIFDECRSPCSLTPEPGKPIQSKLSIPGDVVLDEGVL YYSMTINDEQNDIKDEDKGESIITIGEFATVRATRHYVNQDA PFGVIHLDITTENGTKTYSFNRKEGEFAINWLVPIGEDSPAS IKISIDELDQQRNIIEVPKLYSIDLDNQTLEQWETQGNVSFA VTRPEQSIAISWPSVSYKAAQKDGARHKRWAHWHTGLALCWL VPLDAIYNYITQQNCTLGDNWFGGSYETVAGTPKAITVKQGM EQKPVEQRIHFSKKNAMEALAAHRVCGVPLETLARGRKPRDL TDDLQCAYQAQNIVSLFLATRILFSHLDSVFTLNLDEQEPEV AERLTDLRRINENNPGMVTQVLTIARQIYNDYVTEHPGLTPE QTSAGAQAADILSLFCPDADESCVASNSDQANINIESRSGRS YLPENRAVITPQGVTNWTYQELEAKHQTLTREGYVFVGYHGT NHVAAQSIVNRITPVPRGNNTEKEEEWGGVYVATHAEVNHRY ARIKEGTGENGLPTTEEKKSRGVMLRVYLPRASLERFYRTNI PLENADEHVTQVIGHPLPLRNEAFTGPESAGGEDETAIGWDM AIHGVAIPSTIPGNSYAQLPIDEEAVAKEQSISAKPPYKEHD ELK | Naturally occurring Cholix polypeptide |
| SEQ ID NO: 60 | VEDELNIFDECRSPCSLTPEPGKPIQSKLSIPGDVVLDEGVL YYSMTINDEQNDIKDEDKGESIITIGEFATVRATRHYVNQDA PFGVIHLDITTENGTKTYSFNRKEGEFAINWLVPIGEDSPAS IKISIDELDQQRNIIEVPKLYSIDLDNQTLEQWETQGNVSFA VTRPEQSIAISWPSVSYKAAQKDGARHKRWAHWHTGLALCWL VPLDAIYNYITQQNCTLGDNWFGGSYETVAGTPKAITVKQGM EQKPVEQRIHFSKKNAMEALAAHRVCGVPLETLARGRKPRDL TDDLQCAYQAQNIVSLFLATRILFSHLDSVFTLNLDEQEPEV AERLTDLRRINENNPGMVTQVLTIARQIYNDYVTEHPGLTPE QTSAGAQAADILSLFCPDADESCVASNSDQANINIESRSGRS YLPENRAVITPQGVTNWTYQELEAKHQTLTREGYVFVGYHGT NHVAAQSIVNRITPVPRGNNTEKEEEWGGVYVATHAELAHRY ARIKEGTGENGLPTTEKKKSRGVMLKVYLPRASLERFYRTNI PLENADEHVTQVIGHPLPLRNEAFTGPESAGGENETAIGWDM AIHGVAIPSTIPGNSYAQLPIDEEAVAKEQSISAKPPYKEHD ELK | Naturally occurring Cholix polypeptide |
| SEQ ID NO: 61 | VEDELNIFDECRSPCSLTPELGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDEIDQQRNIIEVPKLYSIDLDNQTLEQWENQGNVSFA VTRPEQSIAISWPSVSYKAAHKNGSRHKRWANWFTTSPKVTL CFYEDPAQCTYGDDWHGGAYKTVAGTPKAITVKQGIEQKTVE QRIHFSKKNAMEALAAHRVCGVPLETLARSRKPRDLPDDLSC AYQAQNIVSLFVATRILFSHLDSVFTLNLDEQEPEVAERLSA LRQINENNPGMVTQVLTVARQIYNDYVTHHPGLTPEQTSAGA QAADILSLFCPDADKSCVASNNDQANINIESRSGRSYLPENR AVITPQGVTNWTYQELEATHQALTREDYVFVGYHGTNHVAAQ TIVNRIAPVPRGNNTENEEKWGGLYVATHAEVAHGYARIKEG TGEYGLPTRAEQETRGVMLRVYIPRASLERFYRTNTPLENAE EHITQVIGHSLPLRNEAFTGPESAGGEDETVIGWDMAIHAVA IPSTIPGNAYEGLTTDEEAVVKEAIAKEQSISAKPPYKEQKD ELK | Naturally occurring Cholix polypeptide |
| SEQ ID NO: 62 | VEDELNIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVIPGEDSPAS IKISVDEIDQQRNIIEVPKLYSIDLDNQTLEQWENQGNVSFA VTRPEQSIAISWPSVSYKAAHKNGSRHKRWANWFTTSPKVTL CFYEDPAQCTYGDDWHGGAYKTVAGTPKAITVKQGIEQKTVE QRIHFSKKNAMEALAAHRVCGVPLETLARSRKPRDLPDDLSC AYQAQNIVSLFVATRILFSHLDSVFTLNLDEQEPEVAERLSA LRQINENNPGMVTQVLTVARQIYNDYVTHHPGLTPEQTSAGA QAADILSLFCPDADKSCVASNNDQANINIESRSGRSYLPENR AVITPQGVTNWTYQELEATHQALTREDYVFVGYHGTNHVAAQ TIVNRIAPVPRGNNTENEEKWGGLYVATHAEVAHGYARIKEG TGEYGLPTRAEQETRGVMLRVYIPRASLERFYRTNTPLENAE EHITQVIGHSLPLRNEAFTGPESAGGEDETVIGWDMAIHAVA IPSTIPGNAYEGLTTDEEAVVKEAIAKEQSISAKPPYKERKD ELK | Naturally occurring Cholix polypeptide |
| SEQ ID NO: 63 | VEDELNIFDECRSPCSLTPEPGKPIQSKLSIPGDVVLDEGVL YYSMTINDEQNDIKDEDKGESIITIGEFATVRATRHYVNQDA | Naturally occurring |

TABLE 1-continued

Exemplary Cholix Polypeptide Sequences

| SEQ ID NO | Amino Acid Sequence | Description |
|---|---|---|
| | PFGVIHLDITTENGTKTYSFNRKEGEFAINWLVIPGEDSPAS<br>IKISIDELDQQRNIIEVPKLYSIDLDNQTLEQWETQGNVSFA<br>VTRPEQSIAISWPSVSYKAAQKDGARHKRWAHWHTGLALCWL<br>VPLDAIYNYITQQNCTLGDNWFGGSYETVAGTPKAITVKQGM<br>EQKPVEQRIHFSKKNAMEALAAHRVCGVPLETLARGRKPRDL<br>TDDLQCAYQAQNIVSLFLATRILFSHLDSVFTLNLDEQEPEV<br>AERLTDLRRINENNPGMVTQVLTIARQIYNDYVTEHPGLTPE<br>QTSAGAQAADILSLFCPDADESCVASNSDQANINIESRSGRS<br>YLPENRAVITPQGVTNWTYQELEAKHQTLTREGYVFVGYHGT<br>NHVAAQSIVNRITPVPRGNNTEKEEEWGGVYVATHAELAHRY<br>ARIKEGTGENGLPTTEEKKSRGVMLRVYLPRASLERFYRTNI<br>PLENADEHVTQVIGHPLPLRNEAFTGPESAGGEDETAIGWDM<br>AIHGVAIPSTIPGNSYAQLPIDEEAVAKEQSISAKPPYKEHD<br>ELK | Cholix<br>polypeptide |
| SEQ ID NO: 64 | VEDELNIFDECRSPCSLTPEPGKPIQSKLSIPSDVVLDEGVL<br>YYSMTINDEQNDIKDEDKGESIITIGEFATVRATRHYVSQDA<br>PFGVINLDITTENGTKTYSFNRKESEFAINWLVPIGEDSPAS<br>IKISVDELDQQRNIIEVPKLYSIDLDNQTLEQWETQGNVSFA<br>VTRPEQSIAISWPSVSYKAAHKNGSRHKRWANWFTTSPKVTL<br>CFYEDPAQCTYGDDWHGGAYKTVAGTPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREGYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPESAGGEDETVIGWDMAIHAVA<br>IPSTIPGNAYEELAIDEEAVAKEQSISTKPPYKERKDELK | Naturally<br>occurring<br>Cholix<br>polypeptide |
| SEQ ID NO: 65 | VEDELNIFDECRSPCSLTPEPGKPIQSKLSIPSDVVLDEGVL<br>YYSMTINDEQNDIKDEDKGESIITIGEFATVRATRHYVSQDA<br>PFGVINLDITTENGTKTYSFNRKESEFAINWLVPIGEDSPAS<br>IKISVDELDQQRNIIEVPKLYSIDLDNQTLEQWETQGNVSFA<br>VTRPEQSIAISWPSVSYKAAHKNGSRHKRWANWFTTSPKVTL<br>CFYEDPAQCTYGDDWHGGAYKTVAGTPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREDYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPESAGGEDETVIGWDMAIHAVA<br>IPSTIPGNAYEELAIDEEAVAKEQSISTKPPYKERKDELK | Naturally<br>occurring<br>Cholix<br>polypeptide |
| SEQ ID NO: 66 | VEDELNIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWKTQGNVSFS<br>VTRPEQSIAISWPSVSYNAAHKNGSRHKRWANWFTTSPKVTL<br>CFYEDPAQCTYGDDWHGGAYKTVAGTPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINVESRSGRSYLPENR<br>AVITPQGVTNWTYQELEATHQALTREGYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPESAGGEDETVIGWDMAIHAVA<br>IPSTIPGNAYEELAIDEEAVAKEQSISTKPPYKERKDELK | Naturally<br>occurring<br>Cholix<br>polypeptide |
| SEQ ID NO: 67 | VEDELNIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWENQGNVSFA<br>VTRPEQSIAISWPSVSYKAAHKNGSRHKRWANWLTTLPKVVL<br>CFYEDPELCTYGDDWHGGAYKTVAGTPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREGYVFVGYHGTNHVAAQ<br>TIVNRIAPVPRGNNTENEEKWGGLYVATHAEVAHGYARIKEG<br>TGNGGLPTRAERDARGVMLRVYIPRASLERFYRTNTPLENAE | Naturally<br>occurring<br>Cholix<br>polypeptide |

TABLE 1-continued

Exemplary Cholix Polypeptide Sequences

| SEQ ID NO | Amino Acid Sequence | Description |
| --- | --- | --- |
| | EHITQVIGHSLPLRNEAFTGPESAGGEDETVIGWDMAIHAVA<br>IPSTIPGNAYEELAIDEEAVAKEQSISAKPPYKEQKDELK | |
| SEQ ID NO: 68 | VEDELNIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDEIDQQRNIIEVPKLYSIDLDNQTLEQWENQGNVSFA<br>VTRPEQSIAISWPSVSYKAAHKNGSRHKRWANWFTTSPKVTL<br>CFYEDPAQCTYGDDWHGGAYKTVAGTPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREGYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPERVDGEDETVIGWDMAIHAVA<br>IPSTIPGNAYEELAIDEEAVAKEQSISTKPPYKERKDELK | Naturally<br>occurring<br>Cholix<br>polypeptide |
| SEQ ID NO: 69 | VEDELNIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKMYSYNRKEGEFAINWLVPIGEDSPAS<br>IKISVDEIDQQRNIIEVPKLYSIDLDNQTLEQWENQGNVSFA<br>VTRPEQSIAISWPSVSYKAAHKNGSRHKRWANWFTTSPKVTL<br>CFYEDPAQCTYGDDWHGGAYKTVAGTPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREGYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPERVDGEDETVIGWDMAIHAVA<br>IPSTIPGNAYEELAIDEEAVAKEQSISTKPPYKERKDELK | Naturally<br>occurring<br>Cholix<br>polypeptide |
| SEQ ID NO: 70 | VEDELNIFDECRSPCSLTPEPGKPIQSKLSIPSDVVLDEGVL<br>YYSMTINDEQNDIKDEDKGESIITIGEFATVRATRHYVNQDA<br>PFGVIHLDITTENGTKTYSYNRKEGEFAINWLVPIGEDSPAS<br>IKISVDELDQKRNIIEVPKLYSIDLDNQTLEQWENQGNVSFA<br>VTRPEQSIAISWPSVSYKAAHKNGSRHKRWANWLTTLPKVVL<br>CFYEEPELCTYGEDWHGGAYKTVAGTPEAITVKQGIEQKTVE<br>QRIHFSKKNAMEALAAHRVCGVPLETLARSRKPRDLQDDLSC<br>AYQAQNIVSLFVATRILFSHLDSVFTLNLDEQEPAVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREGYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPESAGGEDETVIGWDMAIHAVA<br>IPSTIPGNAYEELAIDEEAVAKEQSISAKPPYKEQKDELK | Naturally<br>occurring<br>Cholix<br>polypeptide |
| SEQ ID NO: 71 | VEDELNIFDECRSPCSLTPEPGKPIQSKLSIPGDVVLDEGVL<br>YYSMTINDEQNDIKDEDKGESIITIGEFATVRATRHYVSQDA<br>PFGVINLDITTENGTKTYSFNRKESEFAINWLVPIGEDSPAS<br>IKISIDELDQQRNIIEVPKLYSIDLDNQTLEQWENQGNVSFA<br>VTRPEQSIAISWPSVSYKAAHKNGSRHKRWANWLTTLPEVVL<br>CFFEDPELCTYGDDWHGGAYKTVAGTPKAITVKQGIEQKTVE<br>QRIHFSKKNAMEALAAHRVCGVPLETLARSRKPRDLPDDLSC<br>AYNAQQIVSLFLATRILFTHIDSIFTLNLDGQEPEVAERLDD<br>LRRINENNPGMVIQVLTVARQIYNDYVTHHPGLTPEQTSAGA<br>QAADILSLFCPDADKSCVASNSDQANINIESRSGRSYLPENR<br>AVITQQGVTNWTYQELEATHQALTQEGYVFVGYHGTNHVAAQ<br>SIVNRISPVPRGSDTESERAWGGLYVSTDASVAYGYARIQEG<br>TADGGGLTPAERKARGVMLRVYLPQASLERFYRINADLEKER<br>NLVERVIGHPLPLRNEAFTGTDAEEGSDETAIGWDMAIHGVA<br>IPSTIPGNSYAQLPIDEEAVAKEQSISAKPPYKEQKDELK | Naturally<br>occurring<br>Cholix<br>polypeptide |
| SEQ ID NO: 72 | VEDELNIFDECRSPCSLTPEPGKPIQSKLSIPGDVVLDEGVL<br>YYSMTINDEQNDIKDEDKGESIITIGEFATVRATRHYVSQDA<br>PFGVINLDITTENGTKTYSFNRKESEFAINWLVPIGEDSPAS<br>IKISIDELDQQRNIIEVPKLYSIDLDNQTLEQWENQGNVSFA<br>VTRPEQSIAISWPSVSYKAAHKNGSRHKRWANWLTTLPEVVL<br>CFFEDPELCTYGDDWHGGAYKTVAGTPKAITVKQGIEQKTVE<br>QRIHFSKKNAMEALAAHRVCGVPLETLARSRKPRDLPDDLSC<br>AYNAQQIVSLFLATRILFTHIDSIFTLNLDGQEPEVAERLDD<br>LRRINENNPGMVIQVLTVARQIYNDYVTHHPLLTPEQTSAGA | Naturally<br>occurring<br>Cholix<br>polypeptide |

TABLE 1-continued

Exemplary Cholix Polypeptide Sequences

| SEQ ID NO | Amino Acid Sequence | Description |
|---|---|---|
| | QAADILSLFCPDADKSCVASNSDQANINIESRSGRSYLPENR<br>AVITQQGVTNWTYQELEATHQALTQEGYVFVGYHGTNHVAAQ<br>SIVNRISPVPRGSDTESERAWGGLYVSTDASVAYGYARIQEG<br>TADGGGLTPAERKARGVMLRVYLPQASLERFYRINADLEKER<br>NLVERVIGHPLPLRNEAFTGTDAEEGSDETAIGWDMAIHGVA<br>IPSTIPGNSYAQLPIDEEAVAKEQSISAKPPYKEQKDELK | |
| SEQ ID NO: 73 | VEDELNIFDECRSPCSLTPEPGKPIQSKLSIPGDVVLDEGVL<br>YYSMTINDEQNDIKDEDKGESIITIGEFATVRATRHYVNQDA<br>PFGVINLDITTENGTKTYSFNRKESEFAINWLVPIGEDSPAS<br>IKISIDELDQQRNIIEVPKLYSIDLDNQTLEQWENQGNVSFA<br>VTRPEQSIAISWPSVSYKAAHKNGSRHKRWANWLTTLPEVVL<br>CFFEDPELCTYGDDWHGGAYKTVAGTPKAITVKQGIEQKTVE<br>QRIHFSKKNAMEALAAHRVCGVPLETLARSRKPRDLPDDLSC<br>AYNAQQIVSLFLATRILFTHIDSIFTLNLDGQEPEVAERLDD<br>LRRINENNPGMVIQVLTVARQIYNDYVTHHPGLTPEQTSAGA<br>QAADILSLFCPDADKSCVASNSDQANINIESRSGRSYLPENR<br>AVITQQGVTNWTYQELEATHQALTQEGYVFVGYHGTNHVAAQ<br>SIVNRISPVPRGSDTESERAWGGLYVSTDASVAYGYARIQEG<br>TADGGGLTPAERKARGVMLRVYLPQASLERFYRINADLEKER<br>NLVERVIGHPLPLRNEAFTGTDAEEGSDETAIGWDMAIHGVA<br>IPSTIPGNSYAQLPIDEEAVAKEQSISAKPPYKEQKDELK | Naturally<br>occurring<br>Cholix<br>polypeptide |
| SEQ ID NO: 74 | VEDELNIFDECRSPCSLTPEPGKPIQSKLFIPGDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWENQGNVSFA<br>VTRPEQSIAISWPSVSYKAAHKNGSRHKRWANWLTTLPKVVL<br>CFYEDPELCTYGDDWHGGAYKTVAGTPKAITVKQGIEQKTVE<br>QRIHFSKKNAIEALAAHRVCGVPLETLARSRKPRDLPDDLSC<br>AYQAQNIVSLFVATRILFSHLDSVFTLNLDEQEPAVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREGYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPESAGGEDETVIGWDMAIHAVA<br>IPSTIPGNAYEELAIDEEAVAKEQSISTKPPYKERKDELK | Naturally<br>occurring<br>Cholix<br>polypeptide |
| SEQ ID NO: 75 | VEDELNIFDECRSPCSLTPELGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDEIDQQRNIIEVPKLYSIDLDNQTLEQWENQGNVSFA<br>VTRPEQSIAISWPSVSYKAAHKNGSRHKRWANWFTTSPKVTL<br>CFYEDPAQCTYGDDWYGGAYKTVAGTPKAITVKQGIEQKTVE<br>QRIHFSKKNAMEALAAHRVCGVPLETLARSRKPRDLPDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDTDKSCVASNNDQANINIESRSGRSYLPENR<br>AVITPQGVTNWTYQELEATHQALTREDYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPESAGGEDETVIGWDMAIHAVA<br>IPSTIPGNAYEELAIDEEAVAKEQSISTKPPYKERKDELK | Naturally<br>occurring<br>Cholix<br>polypeptide |
| SEQ ID NO: 76 | VEDELKIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWENQGNVSFA<br>VTRPEQSIAISWPSVSYKAAHKNGSRHKRWANWLTTLPKVVL<br>CFYEDPELCTYGDDWHGGAYKTVAGTPKAITVKQGIEQKTVE<br>QRIHFSKKNAMEALAAHRVCGVPLETLARSRKPRDLTDDLSC<br>AYQAQNIVSLFVATRILFSHLDSVFTLNLDEQEPEVAERLSA<br>LRQINENNPGMVTQVLTVARQIYNDYVTHHPGLTPEQTSAGA<br>QAADILSLFCPDADKSCVASNNDQANINIESRSGRSYLPENR<br>AVITPQGVTNWTYQELEATHQALTREGYVFVGYHGTNHVAAQ<br>TIVNRIAPVPRGNNTENEEKWGGLYVATHAEVAHGYARIKEG<br>TGEYGLPTRAERDARGVMLRVYIPRASLERFYRTNTPLENAE<br>EHITQVIGHSLPLRNEAFTGPESAGGEDETVIGWDMAIHAVA<br>IPSTIPGNAYEELAIDEEAVAKEQSISAKPPYKEQKDELK | Naturally<br>occurring<br>Cholix<br>polypeptide |
| SEQ ID NO: 77 | VEDELKIFDECRSPCSLTPEPGKPIQSKLSIPSDVVLDEGVL<br>YYSMTINDEQNDIKDEDKGESIITIGEFATVRATRHYVNQDA<br>PFGVINLDITTENGTKTYSYNRKEGEFAINWLVPIGEDSPAS<br>IKISVDELDQQRNIIEVPKLYSIDLDNQTLEQWENQGNVSFA<br>VTRPEQSIAISWPSVSYKAAHKNGSRHKRWANWLTTLPKVVL | Naturally<br>occurring<br>Cholix<br>polypeptide |

TABLE 1-continued

Exemplary Cholix Polypeptide Sequences

| SEQ ID NO | Amino Acid Sequence | Description |
|---|---|---|
| | CFYEDPELCTYGDDWHGGAYKTVAGTPKAITVKQGIEQKTVE QRIHFSKKNAMEALAAHRVCGVPLETLARSRKPRDLPDDLSC AYQAQNIVSLFVATRILFSHLDSVFTLNLDEQAPEVAERLSD LRRINEDNPGMVTQVLTVARQIYNDYVTHHPGLTPEQTSAGA QAADILSLFCPDADKSCVASNNDQANINIESRSGRSYLPENR AVITPQGVTNWTYQELETTHQALTREGYVFVGYHGTNHVAAQ TIVNRIAPVPRGNNTENEEKWGGLYVATHAEVAHGYARIKEG TGEYGLPTRAERETRGVMLRVYIPRASLERFYRTNTPLENAE EHITQVIGHSLPLRNEAFTGPESAGGEDETVIGWDMAIHAVA IPSTIPGNAYEELAIDEEAVAKEQSISAKPPYKEQKDELK | |
| SEQ ID NO: 78 | VEDELKIFDECRSPCSLTPEPGKPIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWENQGNVSFA VTRPEQSIAISWPSVSYKAAHKNGSRHKRWANWLTTLPKVVL CFYEDPELCTYGDDWHGGAYKTVAGTPKAITVKQGIEQKAVE QRIHFSKKNAMEALAAHRVCGVPLETLARSRKPRDLPDDLSC AYQAQNIVSLFVATRILFSHLDSVFTLNLDEQEPEVAERLSA LRQINENNPGMVTQVLTVARQIYNDYVTHHPGLTPEQTSAGA QAADILSLFCPDADKSCVASNNDQANINIESRSGRSYLPENR AVITPQGVTNWTYQELEATHQALTREGYVFVGYHGTNHVAAQ TIVNRIAPVPRGNNTENEEKWGGLYVATHAEVAHGYARIKEG TGNGGLPTRAERETRGVMLRVYIPRASLERFYRTNTPLENAE EHITQVIGHSLPLRNEAFTGPESAGGEDETVIGWDMAIYAVA IPSTIPGNAYEELAIDEEAVAKEQSISAKPPYKEQKDELK | Naturally occurring Cholix polypeptide |
| SEQ ID NO: 79 | TPEPGKPIQSKLSIPGDVVLDEGVLYYSMTINDEQNDIKDED KGESIITIGEFATVRATRHYVSQDAPFGVINLDITTENGTKT YSFNRKESEFAINWLVPIGEDSPASIKISIDELDQQRNIIEV PKLYSIDLDNQTLEQWKTQGNVSFSVTRPEHNIAISWPSVSY KAAQKEGSRHKRWAHWHTGLALCWLVPIDAIYNYITQQNCTL GDNWFGGSYETVAGTPKAITVKQGIEQKPVEQRIHFSKKNAM EALAAHRVCGVPLETLARSRKPRDLPDDLSCAYNAQQIVSLF LATRILFTHIDSIFTLNLDGQEPEVAERLDDLRRINENNPGM VIQVLTVARQIYNDYVTHHPGLTPEQTSAGAQAADILSLFCP DADKSCVASNSDQANINIESRSGRSYLPENRAVITQQGVTNW TYQELEATHQALTQEGYVFVGYHGTNHVAAQSIVNRISPVPR GSDTESERAWGGLYVSTDASVAYGYARIQEGTADGGGLTPAE RKARGVMLRVYLPQASLERFYRINADLEKERNLVERVIGHPL PLRNEAFTGTDAEEGSDETAIGWDMAIHGVAIPSTIPGNSYA QLPIDEEAVAKEQSISAKPPYKEQKDELK | Naturally occurring Cholix polypeptide |
| SEQ ID NO: 80 | SIPSDVVLDEGVLYYSMTINDEQNDIKDEDKGESIITIGEFA TVRATRHYVNQDAPFGVINLDITTENGTKTYSYNRKEGEFAI NWLVPIGEDSPASIKISVDELDQQRNIIEVPKLYSIDLDNQT LEQWKTQGNVSFSVTRPEHNIAISWPSVSYKAAQKEGSRHKR WAHWHTGLALCWLVPIDAIYNYITQQNCTLGDNWFGGSYETV AGTPKAITVKQGIEQKPVEQRIHFSKKNAMEALAAHRVCGVP LETLARSRKPRDLPDDLSCAYQAQNIVSLFVATRILFSHLDS VFTLNLDEQEPEVAERLSALRQINENNPGMVTQVLTVARQIY NDYVTHHPGLTPEQTSAGAQAADILSLFCPDADKSCVASNND QANINIESRSGRSYLPENRAVITPQGVTNWTYQELEATHQAL TREGYVFVGYHGTNHVAAQTIVNRIAPVPRGNNTENEEKWGG LYVATHAEVAHGYARIKEGTGEYGLPTRAERDARGVMLRVYI PRASLERFYRTNTPLENAEEHITQVIGHSLPLRNEAFTGPES AGGEDETVIGWDMAIHAVAIPSTIPGNAYEELAIDEEAVAKE QSISTKPPYKERKDELK | Naturally occurring Cholix polypeptide |
| SEQ ID NO: 81 | MTINDEQNDIMDEGKGESIITIGEFATVRATRHYVNQDAPFG VINLDITTENGTKTYSYNRKEGEFAINWLVPIGEDSPASIKI SVDELDQQRNIIEVPKLYSIDLDNQTLEQWENQGNVSFAVTR PEQSIAKQSIAISWPSVSYKAAQKEGSRHKRWAHWHTGLALC WLVPIDAIYNYITQQNCTLGDNWFGGSYETVAGTPKAITVKQ GIEQKPVEQRIHFSKKNAMEALAAHRVCGVPLETLARSRKPR DLTDDLSCAYQAQNIVSLFVATRILFSHLDSVFTLNLDEQEP EVAERLSALRQINENNPGMVTQVLTVARQIYNDYVTHHPGLT PEQTSAGAQAADILSLFCPDADKSCVASNNDQANINIESRSG RSYLPENRAVITPQGVTNWTYQELEATHQALTREGYVFVGYH GTNHVAAQTIVNRIAPVPRGNNTENEEKWGGLYVATHAEVAH GYARIKEGTGEYGLPTRAERDARGVMLRVYIPRASLERFYRT NTPLENAEEHITQVIGHSLPLRNEAFTGPESAGGEDETVIGW DMAIHAVAIPSTIPGNAYEELAIDEEAVAKEQSISTKPPYKE RKDELK | Naturally occurring Cholix polypeptide |

TABLE 1-continued

Exemplary Cholix Polypeptide Sequences

| SEQ ID NO | Amino Acid Sequence | Description |
|---|---|---|
| SEQ ID NO: 82 | CSLTPEPGKPIQSKLSIPSDVVLDEGVLYYSMTINDEQNDIM DEGKGESIITIGEFATVRATRHYVNQDAPFGVINLDITTENG TKTYSYNRKEGEFTINWLVPIGEDSPASIKISVDELDQQRNI IEVPKLYSIDLDNQTLEQWENQGNVSFAVTRPEQSIAKQSIA ISWPSVSYKAAQKEGSRHKRWAHWHTGLALCWLVPIDAIYNY ITQQNCTLGDNWFGGSYETVAGTPKAITVKQGIEQKPVEQRI HFSKKNAMEALAAHRVCGVPLETLARSRKPRDLTDDLSCAYQ AQNIVSLFVATRILFSHLDSVFTLNLDEQEPEVAERLSDLRR INENNPGMVTQVLTVARQIYNDYVTHHPGLTPEQTSAGAQAA DILSLFCPDADKSCVASNNDQANINIESRSGRSYLPENRAVI TPQGVTNWTYQELEATHQALTREGYVFVGYHGTNHVAAQTIV NRIAPVPRGNNTENEEKWGGLYVATHAEVAHGYARIKEGTGE YGLPTRAERDARGVMLRVYIPRASLERFYRTNTPLENAEEHI TQVIGHSLPLRNEAFTGPESAGGEDETIIGWDMAIHAVAIPS | Naturally occurring Cholix polypeptide |
| SEQ ID NO: 83 | CSLTPEPGKPIQSKLSIPSDVVLDEGVLYYSMTINDEQNDIM DEGKGESIITIGEFATVRATRHYVNQDAPFGVINLDITTENG TKTYSYNRKEGEFAINWLVPIGEDSPASIKISVDELDQQRNI IEVPKLYSIDLDNQTLEQWENQGNVSFAVTRPEQSIAKQSIA ISWPSVSYKAAQKEGSRHKRWAHWHTGLALCWLVPMDAIYNY ITQQNCTLGDNWFGGSYETVAGTPKAITVKQGIEQKPVEQRI HFSKKNAMEALAAHRVCGVPLETLARSRKPRDLTDDLSCAYQ AQNIVSLFVATRILFSHLDSVFTLNLDEQEPEVAERLSALRQ INENNPGMVTQVLTVARQIYNDYVTHHPGLTPEQTSAGAQAA DILSLFCPDADKSCVASNNDQANINIESRSGRSYLPENRAVI TPQGVTNWTYQELEATHQALTREGYVFVGYHGTNHVAAQTIV NRIAPVPRGNNTENEEKWGGLYVATHAEVAHGYARIKEGTGE YGLPTRAERDARGVMLRVYIPRASLERFYRTNTPLENAEEHI TQVIGHSLPLRNEAFTGPESAGGEDETVIGWDMAIHAVAIPS | Naturally occurring Cholix polypeptide |
| SEQ ID NO: 84 | CSLTPEPGKPIQSKLSIPSDVVLDEGVLYYSMTINDEQNDIM DEGKGESIITIGEFATVRATRHYVNQDAPFGVINLDITTENG TKTYSYNRKEGEFAINWLVPIGEDSPASIKISVDELDQQRNI IEVPKLYSIDLDNQTLEQWENQGNVSFAVTRPEQSIAKQSIA ISWPSVSYKAAQKEGSRHKRWAHWHTGLALCWLVPIDAIYNY ITQQNCTLGDNWFGGSYETVAGTPKAITVKQGIEQKPVEQRI HFSKKNAMEALAAHRVCGVPLETLARSRKPRDLTDDLSCAYQ AQNIVSLFVATRILFSHLDSVFTLNLDEQEPEVAERLSALRQ INENNPGMVTQVLTVARQIYNDYVTHHPGLTPEQTSAGAQAA DILSLFCPDADKSCVASNNDQANINIESRSGRSYLPENRAVI TPQGVTNWTYQELEATHQALTREGYVFVGYHGTNHVAAQTIV NRIAPVPRGNNTENEEKWGGLYVATHAEVAHGYARIKEGTGE YGLPTRAERDARGVMLRVYIPRASLERFYRTNTPLENAEEHI TQVIGHSLPLRNEAFTGPESAGGEDETVIGWDMAIHAVAIPS | Naturally occurring Cholix polypeptide |
| SEQ ID NO: 85 | MTINDEQNDIKDEDKGESIITIGEFATVRATRHYVNQDAPFG VINLDITTENGTKTYSYNRKEGEFAINWLVPIGEDSPASIKI SVDELDQQRNIIEVPKLYSIDLDNQTLEQWENQGNVSFAVTR PEQSIAISWPSVSYKAAHKNGSRHKRWANWLTTLPKVVLCFY EDPELCTYGDDWHGGAYKTVAGTPKAITVKQGIEQKAVEQRI HFSKKNAMEALAAHRVCGVPLETLARSRKPRDLPDDLSCAYQ AQNIVSLFVATRILFSHLDSVFTLNLDEQEPEVAERLSALRQ INENNPGMVTQVLTVARQIYNDYVTHHPGLTPEQTSAGAQAA DILSLFCPDADKSCVASNNDQANINIESRSGRSYLPENRAVI TPQGVTNWTYQELEATHQALTREGYVFVGYHGTNHVAAQTIV NRIAPVPRGNNTENEEKWGGLYVATHAEVAHGYARIKEGTGN GGLPTRAERETRGVMLRVYIPRASLERFYRTNTPLENAEEHI TQVIGHSLPLRNEAFTGPESAGGEDETVIGWDMAIYAVAIPS TIPGNAYEELAIDEEAVAKEQSISAKPPYKEQKDELK | Naturally occurring Cholix polypeptide |
| SEQ ID NO: 86 | MTINDEQNDIKDEDKGESIITIGDFATVRATRHYVNQDAPFG VINLDITTENGTKTYSYNRKEGEFAINWLVPIGEDSPASIKI SVDEIDQQRNIIEVPKLYSIDLDNQTLEQWENQGNVSFAVTR PEQSIAISWPSVSYKAAHKNGSRHKRWANWFTTSPKVTLCFY EDPAQCTYGDDWHGGAYKTVAGTPKAITVKQGIEQKTVEQRI HFSKKNAMEALAAHRVCGVPLETLARSRKPRDLPDDLSCAYQ AQNIVSLFVATRILFSHLDSVFTLNLDEQEPEVAERLSALRQ INENNPGMVTQVLTVARQIYNDYVTHHPGLTPEQTSAGAQAA DILSLFCPDADKSCVASNNDQANINIESRSGRSYLPENRAVI TPQGVTNWTYQELEATHQALTREGYVFVGYHGTNHVAAQTIV NRIAPVPRGNNTENEEKWGGLYVATHAEVAHGYARIKEGTGE YGLPTRAERDARGVMLRVYIPRASLERFYRTNTPLENAEEHI TQVIGHSLPLRNEAFTGPERVDGEDETVIGWDMAIHAVAIPS TIPGNAYEELAIDEEAVAKEQSISTKPPYKERKDELK | Naturally occurring Cholix polypeptide |

TABLE 1-continued

Exemplary Cholix Polypeptide Sequences

| SEQ ID NO | Amino Acid Sequence | Description |
| --- | --- | --- |
| SEQ ID NO: 87 | CSLTPEPGKPIQSQLSIPSDVVLDEGVLYYSMTINDEQNDIK<br>DEDKGESIITIGEFATVRATRHYVNQDAPFGVIHLDITTENG<br>TKTYSYNRKEGEFAINWLVPIGEDSPASIKISVDELDQQRNI<br>IEVPKLYSIDLDNQTLEQWENQGNVSFSVTRPEHNIAISWPS<br>VSYKAAQKEGSRHKRWAHWHTGLALCWLVPIDAIYNYITQQN<br>CTLGDNWFGGSYETVAGTPKAITVKQGIEQKTVEQRIHFSKK<br>NAMEALAAHRVCGVPLETLARSRKPRDLTDDLSCVYQAQNIV<br>SLFVATRILFSHLDSVFTLNLEEQEPEVAERLSALRQINENN<br>PGMVTQVLTVARQIYNDYVTHHPGLTPEQTSAGAQAADILSL<br>FCPDADKSCVASNNDQANINIESRSGRSYLPENRAVITPQGV<br>TNWTYQELEATHQALTREGYVFVGYHGTNHVAAQTIVNRIAP<br>VPRGNNTENEEKWGGLYVATHAEVAHGYARIKEGTGEYGLPT<br>RAERDARGVMLRVYIPRASLERFYRTNTPLENAEEHITQVIG<br>HSLPLRNEAFTGPERAGGEDETVIGWDMAIHAVAIPS | Naturally<br>occurring<br>Cholix<br>polypeptide |
| SEQ ID NO: 88 | CSLTPEPGKPIQSKLSIPSDVVLDEGVLYYSMTINDEQNDIK<br>DEDKGESIITIGEFATVRATRHYVNQDAPFGVINLDITTENG<br>TKTYSYNRKEGEFAINWLVPIGEDSPASIKISVDELDQQRNI<br>IEVPKLYSIDLDNQTLEQWKTQGNVSFSVTRPEHNIAISWPS<br>VSYKAAQKEGSRHKRWAHWHTGLALCWLVPMDAIYNYITQQN<br>CTLGDNWFGGSYETVAGTPKVITVKQGIEQKPVEQRIHFSKG<br>NAMSALAAHRVCGVPLETLARSRKPRDLTDDLSCAYQAQNIV<br>SLFVATRILFSHLDSVFTLNLDEQEPEVAERLSALRQINENN<br>PGMVTQVLTVARQIYNDYVTHHPGLTPEQTSAGAQAADILSL<br>FCPDADKSCVASNNDQANINIESRSGRSYLPENRAVITPQGV<br>TNWTYQELEATHQALTREGYVFVGYHGTNHVAAQTIVNRIAP<br>VPRGNNTENEEKWGGLYVATHAEVAHGYARIKEGTGEYGLPT<br>RAERDARGVMLRVYIPRASLERFYRTNTPLENAEEHITQVIG<br>HSLPLRNEAFTGPESAGGEDETVIGWDMAIHAVAIPS | Naturally<br>occurring<br>Cholix<br>polypeptide |
| SEQ ID NO: 89 | CSLTPEPGKPIQSKLSIPSDVVLDEGVLYYSMTINDEQNDIK<br>DEDKGESIITIGEFATVRATRHYVNQDAPFGVINLDITTENG<br>TKTYSYNRKEGEFAINWLVPIGEDSPASIKISVDELDQQRNI<br>IEVPKLYSIDLDNQTLEQWKTQGNVSFSVTRPEHNIAISWPS<br>VSYKAAQKEGSRHKRWAHWHTGLALCWLVPIDAIYNYITQQN<br>CTLGDNWFGGSYETVAGTPKAITVKQGIEQKPVEQRIHFSKK<br>NAMEALAAHRVCGVPLETLARSRKPRDLPDDLSCAYQAQNIV<br>SLFVATRILFSHLDSVFTLNLDEQEPEVAERLSALRQINENN<br>PGMVTQVLTVARQIYNDYVTHHPGLTPEQTSAGAQAADILSL<br>FCPDADKSCVASNNDQANINIESRSGRSYLPENRAVITPQGV<br>TNWTYQELEATHQALTREGYVFVGYHGTNHVAAQTIVNRIAP<br>VPRGNNTENEEKWGGLYVATHAEVAHGYARIKEGTGEYGLPT<br>RAERDARGVMLRVYIPRASLERFYRTNTPLENAEEHITQVIG<br>HSLPLRNEAFTGPESAGGEDETVIGWDMAIHAVAIPS | Naturally<br>occurring<br>Cholix<br>polypeptide |
| SEQ ID NO: 90 | CSLTPEPGKPIQSKLSIPSDVVLDEGVLYYSMTINDEQNDIK<br>DEDKGESIITIGEFATVRATRHYVNQDAPFGVINLDITTENG<br>TKTYSYNRKEGEFAINWLVPIGEDSPASIKISVDELDQQRNI<br>IEVPKLYSIDLDNQTLEQWKTQGNVSFSVTRPEHNIAISWPS<br>VSYKAAQKEGSRHKRWAHWHTGLALCWLVPIDAIYNYITQQN<br>CTLGDNWFGGSYETVAGTPKAITVKQGIEQKPVEQRIHFSKK<br>NAMEALAAHRVCGVPLETLARSRKPRDLPDDLSCAYQAQNIV<br>SLFVATRILFSHLDSVFTLNLDEQEPEVAERLSALRQINENN<br>PGMVTQVLTVARQIYNDYVTHHPGLIPEQTSAGAQAADILSL<br>FCPDADKPCVASNNDQANINIESRSGRSYLPENRAVITPQGV<br>TNWTYQELEATHQALTREGYVFVGYHGTNHVAAQTIVNRIAP<br>VPRGNNTENEEKWGGLYVATHAEVAHGYARIKEGTGEYGLPT<br>RAEREARGVMLRVYIPRASLERFYRTNTPLENAERHITQVIG<br>HSLPLRNEAFTGPESAGGEDETVIGWDMAIHAVAIPS | Naturally<br>occurring<br>Cholix<br>polypeptide |
| SEQ ID NO: 91 | CSLTPEPGKPIQSKLSIPSDVVLDEGVLYYSMTINDEQNDIK<br>DEDKGESIITIGEFATVRATRHYVNQDAPFGVINLDITTENG<br>TKTYSYNRKEGEFAINWLVPIGEDSPASIKISVDELDQQRNI<br>IEVPKLYSIDLDNQTLEQWENQGNVSFSVTRPEHNIAISWPS<br>VSYKAAQKEGSRHKRWAHWHTGLALCWLVPIDAIYNYITQQN<br>CTLGDNWFGGSYETVAGTPKAITVKQGIEQKTVEQRIHFSKK<br>NAMEALAAHRVCGVPLETLARSRKPRDLTDDLSCVYQAQNIV<br>SLFVATRILFSHLDSVFTLNLEEQEPEVAERLSALRQINENN<br>PGMVTQVLTVARQIYNDYVTHHPGLTPEQTSAGAQAADILSL<br>FCPDADKSCVASNNDQANINIESRSGRSYLPENRAVITPQGV<br>TNWTYQELEATHQALTREGYVFVGYHGTNHVAAQTIVNRIAP<br>VPRGNNTENEEKWGGLYVATHAEVAHGYARIKEGTGNGGLPT<br>RAERETRGVMLRVYIPRASLERFYRTNTPLENAEEHITDVIG<br>HSLPLRNEAFTGPESAGGEDETVIGWDMAIHAVAIPS | Naturally<br>occurring<br>Cholix<br>polypeptide |

TABLE 1-continued

Exemplary Cholix Polypeptide Sequences

| SEQ ID NO | Amino Acid Sequence | Description |
| --- | --- | --- |
| SEQ ID NO: 92 | CSLTPEPGKPIQSKLSIPSDVVLDEGVLYYSMTINDEQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWENQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPAVAERLSALRQINENN PGMVTQVLTVARQIYNDYVTHHPGLTPEQTSAGAQAADILSL FCPDADKSCVALNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 93 | CSLTPEPGKPIQSKLSIPSDVVLDEGVLYYSMTINDEQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWENQGNVSFSVTRPEHNIAISWPS VSYKAAQKEGSRHKRWAHWHTGLALCWLVPIDAIYNYITQQN CTLGDNWFGGSYETVAGTPKAIMVKQGIEQKPVEQRIHFSKK NAMEALAAHRVCGVPLETLARSRKPRYLPDDLSCAYQAQNIV SLFVATRILFSHLDSVFTLNLDEQEPEVAERLSALRQINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPERVDGEDETVIGWDMAIHAVAIPS | Naturally occurring Cholix polypeptide |
| SEQ ID NO: 94 | CSLTPEPGKPIQSKLSIPSDVVLDEGVLYYSMTINDEQNDIK DEDKGESIITIGEFATVRATRHYVNQDAPFGVINLDITTENG TKTYSYNRKDGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPAVAERLSAIRQINENN PGMVTQVLTVARQIYNDYVTHHPGLTPEQTSAGAQAADILSL FCPDADKSCVASDNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 95 | CSLTPEPGKPIQSKLSIPSDVVLDEGVLYYSMTINDEQNDIK DEDKGESIITIGEFATVRATRHYVNQDAPFGVINLDITTENG TKTYSYNRKDGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPAVAERLSALRQINENN PGMVTQVLTVARQIYNDYVTHHPGLTPEQTSAGAQAADILSL FCPDADKSCVASDNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYLTNTPLENAEEHITQVIG HSLPLRNEAFTGPESAGGEDETVIGWDMAIHAVAIPS | Naturally occurring Cholix polypeptide |
| SEQ ID NO: 96 | CSLTPEPGKPIQSKLSIPSDVVLDEGVLYYSMTINDEQNDIK DEDKGESIITIGEFATVRATRHYVNQDAPFGVIHLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPMDAIYNYITQQN CTLGDNWFGGSYETVAGTPKVITVKQGIEQKPVEQRIHFSKG NAMSALAAHRVCGVPLETLARSRKPRDLTDDLSCAYQAQNIV SLFVATRILFSHLDSVFTLNLDEQEPAVAERLSDLRRINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |

TABLE 1-continued

Exemplary Cholix Polypeptide Sequences

| SEQ ID NO | Amino Acid Sequence | Description |
| --- | --- | --- |
| SEQ ID NO: 97 | CSLTPEPGKPIQSKLSIPSDVVLDEGVLYYSMTINDEQNDIK DEDKGESIITIGEFATVRATRHYVNQDAPFGVIHLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPMDAIYNYITQQN CTLGDNWFGGSYETVAGTPKVITVKQGIEQKPVEQRIHFSKG NAMSALAAHRVCGVPLETLARSRKPRDLTDDLSCAYQAQNIV SLFVATRILFSHLDSVFTLNLDEQEPEVAERLSDLRRINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYTRIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 98 | CSLTPEPGKPIQSKLSIPSDVVLDEGVLYYSMTINDEQNDIK DEDKGESIITIGEFATVRATRHYVNQDAPFGVIHLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPMDAIYNYITQQN CTLGDNWFGGSYETVAGTPKVITVKQGIEQKPVEQRIHFSKG NAMSALAAHRVCGVPLETLARSRKPRDLTDDLSCAYQAQNIV SLFVATRILFSHLDSVFTLNLDEQEPEVAERLSDLRRINENN PGMVTQVLTVARQIYNDYVTHHPGLTPEQTSAGAQAADILSL FYPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 99 | CSLTPEPGKPIQSKLSIPSDVVLDEGVLYYSMTINDEQNDIK DEDKGESIITIGEFATVRATRHYVNQDAPFGVIHLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPMDAIYNYITQQN CTLGDNWFGGSYETVAGTPKVITVKQGIEQKPVEQRIHFSKG NAMSALAAHRVCGVPLETLARSRKPRDLTDDLSCAYQAQNIV SLFVATRILFSHLDSVFTLNLDEQEPEVAERLSDLRRINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGNGGLPT RAERETRGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 100 | CSLTPEPGKPIQSKLSIPSDVVLDEGVLYYSMTINDEQNDIK DEDKGESIITIGEFATVRATRHYVNQDAPFGVIHLDITTENG TKTYSYNRKEGEFAINWLVPIGEDSPASIKISVDELDQQRNI IEVPKLYSIDLDNQTLEQWENQGNVSFSVTRPEHNIAISWPS VSYKAAQKEGSRHKRWAHWHTGLALCWLVPMDAIYNYITQKN CTLGDNWFGGSYETVAGTPKVITVKQGIEQKPVEQRIHFSKG NAMSALAAHRVCGVPLETLARSRKPRDLTDDLSCAYQAQNIV SLFVATRILFSHLDSVFTLNLDEQEPEVAERLSDLRRINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 101 | CSLTPEPGKPIQSKLSIPSDVVLDEGVLYYSMTINDEQNDIK DEDKGESIITIGEFATVRATRHYVNQDAPFGVIHLDITTENG TKTYSYNRKEGEFAINWLVPIGEDSPASIKISVDELDQQRNI IEVPKLYSIDLDNQTLEQWENQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPEVAERLSALRQINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |

TABLE 1-continued

Exemplary Cholix Polypeptide Sequences

| SEQ ID NO | Amino Acid Sequence | Description |
|---|---|---|
| SEQ ID NO: 102 | CSLTPELGKPIQSKLSISSDVVLDEGVLYYSMTINDEQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPEVAERLSALRQINENN PGMVTQVLTVARQIYNDYVTHHPGLTPEQTSAGAQAADILSL FCPDADKPCVASNNDQANINVESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAERHITQVIG HSLPLRNEAFTGPESAGGEDETVIGWDMAIHAVAIPS | Naturally occurring Cholix polypeptide |
| SEQ ID NO: 103 | CSLTPELGKPIQSKLSIPSDVVLDEGVLYYSMTINDEQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPEVAERLSALRQINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 104 | CSLTPELGKPIQSKLSIPSDVVLDEGVLYYSMTINDEQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLEEQEPEVAERLSALRQINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 105 | CSLTPELGKPIQSKLSIPSDVVLDEGVLYYSMTINDEQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPAVAERLSALRQINENN PGMVTQVLTVARQIYNDYVTHHPGLTPEQTSAGAQAADILSL FCPDADKSCVASDNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 106 | CSLTPELGKPIQSKLSIPSDVVLDEGVLYYSMTINDEQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPEVAERLSALRQINENN PGMVTQVLTVARQIYNDYVTHHPGLTPEQTSAGAQAADILSL FCPDADKPCVASNNDQANINVESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAEREARGVMLRVYIPRASLERFYRTNTPLENAERHITQVIG HSLPLRNEAFTGPESAGGEDETVIGWDMAIHAVAIPS | Naturally occurring Cholix polypeptide |

TABLE 1-continued

Exemplary Cholix Polypeptide Sequences

| SEQ ID NO | Amino Acid Sequence | Description |
|---|---|---|
| SEQ ID NO: 107 | CSLTPELGKPIQSKLSIPSDVVLDEGVLYYSMTINDEQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPAVAERLSALRQINENN PGMVTQVLTVARQIYNDYVTHHPGLTPEQTSAGAQAADILSL FCPDADKSCVASNNDQANINIESRSGRSYLPENRAVITPQGV TNWTYQELEATHQALTREGYVFVGYHGTNHVAAQTIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPERVDGEDETVIGWDMAIHAVAIPS | Naturally occurring Cholix polypeptide |
| SEQ ID NO: 108 | CSLTPELGKPIQSKLSIPSDVVLDEGVLYYSMTINDDQNDIK DEDKGESIITIGEFATVRATRHYVNQDAPFGVINLDITTENG TKTYSYNRKEGEFAINWLVPIGEDSPASIKISVDELDQQRNI IEVPKLYSIDLDNQTLEQWKTQGNVSFSVTRPEHNIAISWPS VSYKAAQKEGSRHKRWAHWHTGLALCWLVPIDAIYNYITQQN CTLGDNWFGGSYETVAGTPKAITVKQGIEQKPVEQRIHFSKK NAMEALAAHRVCGVPLETLARSRKPRDLPDDLSCAYQAQNIV SLFVATRILFSHLDSVFTLNLDEQEPEVAERLSALRQINENN PGMVTQVLTVARQIYNDYVTHHPGLTPEQTSAGAQAADILSL FCPDADKPCVASNNDQANINIESRSGRSYLPENRAVITPQGV TNWTYQELEATHQALTREGYVFVGYHGTNHVAAQNIVNRIAP VPRGNNTENEEKWGGLYVATHAEVAHGYARIKEGTGEYGLPT RAERDARGVMLRVYIPRASLERFYRTNTPLENAEEHITQVIG HSLPLRNEAFTGPESAGGEDETVIGWDMAIHAVAIPS | Naturally occurring Cholix polypeptide |
| SEQ ID NO: 109 | CSLTPEPGKPIQSKLSIPSDVVLDEGVLYYSMTINDEQNDIM DEGKGESIITIGEFATVRATRHYVNQDAPFGVINLDITTENG TKTYSYNRKEGEFAINWLVPIGEDSPASIKISVDELDQQRNI IEVPKLYSIDLDNQTLEQWENQGNVSFAVTRPEQSIAKQSIA ISWPSVSYKAAHKNGSRHKRWANWLTTLPKVVLCFFEDPELC TYGEDWHGGAYKTVAGTPKAITVKQGIEQKTVEQRIHFSKKN AMEALAAHRVCGVPLETLARSRKPRDLPDDLSCAYQAQNIVS LFVATRILFSHLDSVFTLNLDEQEPEVAERLSALRQINENNP GMVTQVLTVARQIYNDYVTHHPGLTPEQTSAGAQAADILSLF CPDADKSCVASNNDQANINIESRSGRSYLPENRAVITPQGVT NWTYQELEATHQALTREGYVFVGYHGTNHVAAQTIVNRIAPV PRGNNTENEEKWGGLYVATHAEVAHGYARIKEGTGEYGLPTR AERDARGVMLRVYIPRASLERFYRTNTLLENAEEHITQVIGH SLPLRNEAFTGPESAGGEDETVIGWDMAIHAVAIPS | Naturally occurring Cholix polypeptide |
| SEQ ID NO: 110 | CSLTPEPGKPIQSKLSIPSDVVLDEGVLYYSMTINDEQNDIK DEDKGESIITIGEFATVRATRHYVSQDAPFGVINLDITTENG TKTYSFNRKESEFAINWLVPIGEDSPASIKISVDELDQQRNI IEVPKLYSIDLDNQTLEQWETQGNVSFAVTRPEQSIAISWPS VSYKAAHKNGSRHKRWANWFTTSPKVTLCFYEDPAQCTYGDD WHGGAYKTVAGTPKAITVKQGIEQKTVEQRIHFSKKNAMEAL AAHRVCGVPLETLARSRKPRDLPDDLSCAYQAQNIVSLFVAT RILFSHLDSVFTLNLDEQEPEVAERLSALRQINENNPGMVTQ VLTVARQIYNDYVTHHPGLTPEQTSAGAQAADILSLFCPDAD KSCVASNNDQANINIESRSGRSYLPENRAVITPQGVTNWTYQ ELEATHQALTREDYVFVGYHGTNHVAAQTIVNRIAPVPRGNN TENEEKWGGLYVATHAEVAHGYARIKEGTGEYGLPTRAERDA RGVMLRVYIPRASLERFYRTNTPLENAEEHITQVIGHSLPLR NEAFTGPESAGGEDETVIGWDMAIHAVAIPS | Naturally occurring Cholix polypeptide |
| SEQ ID NO: 111 | CSLTPEPGKPIQSKLSIPSDVVLDEGVLYYSMTINDEQNDIK DEDKGESIITIGEFATVRATRHYVSQDAPFGVINLDITTENG TKTYSFNRKESEFAINWLVPIGEDSPASIKISVDELDQQRNI IEVPKLYSIDLDNQTLEQWETQGNVSFAVTRPEQSIAISWPS VSYKAAHKNGSRHKRWANWFTTSPKVTLCFYEDPAQCTYGDD WHGGAYKTVAGTPKAITVKQGIEQKTVEQRIHFSKKNAMEAL AAHRVCGVPLETLARSRKPRDLPDDLSCAYQAQNIVSLFVAT RILFSHLDSVFTLNLDEQEPEVAERLSALRQINENNPGMVTQ VLTVARQIYNDYVTHHPGLTPEQTSAGAQAADILSLFCPDAD KSCVASNNDQANINIESRSGRSYLPENRAVITPQGVTNWTYQ ELEATHQALTREDYVFVGYHGTNHAAAQTIVNRIAPVPRGNN TENEEKWGGLYVATHAEVAHGYARIKEGTGEYGLPTRAEQET RGVMLRVYIPRASLERFYRTNTPLENAEEHITQVIGHSLPLR NEAFTGPESAGGEDETVIGWDMAIHAVAIPS | Naturally occurring Cholix polypeptide |

TABLE 1-continued

Exemplary Cholix Polypeptide Sequences

| SEQ ID NO | Amino Acid Sequence | Description |
| --- | --- | --- |
| SEQ ID NO: 112 | CSLTPEPGKPIQSKLSIPSDVVLDEGVLYYSMTINDEQNDIK<br>DEDKGESIITIGEFATVRATRHYVNQDAPFGVINLDITTENG<br>TKTYSYNRKEGEFAINWLVPIGEDSPASIKISVDELDQQRNI<br>IEVPKLYSIDLDNQTLEQWENQGNVSFAVTRPEQSIAISWPS<br>VSYKAAHKNGSRHKRWANWLTTLPKVVLCFYEDPELCTYGDD<br>WHGGAYKTVAGTPKAITVKQGIEQKTVEQRIHFSKKNAMEAL<br>AAHRVCGVPLETLARSRKPRDLTDDLSCAYQAQNIVSLFVAT<br>RILFSHLDSVFTLNLDEQEPEVAERLSALRQINENNPGMVTQ<br>VLTVARQIYNDYVTHHPGLTPEQTSAGAQAADILSLFCPDAD<br>KSCVASNNDQANINIESRSGRSYLPENRAVITPQGVTNWTYQ<br>ELEATHQALTREGYVFVGYHGTNHVAAQTIVNRIAPVPRGNN<br>TENEEKWGGLYVATHAEVAHGYARIKEGTGEYGLPTRAERDA<br>RGVMLRVYIPRASLERFYRTNTPLENAEEHITQVIGHSLPLR<br>NEAFTGPESAGGEDETVIGWDMAIHAVAIPS | Naturally<br>occurring<br>Cholix<br>polypeptide |
| SEQ ID NO: 113 | CSLTPEPGKPIQSKLSIPSDVVLDEGVLYYSMTINDEQNDIK<br>DEDKGESIITIGEFATVRATRHYVNQDAPFGVINLDITTENG<br>TKTYSYNRKEGEFAINWLVPIGEDSPASIKISVDELDQQRNI<br>IEVPKLYSIDLDNQTLEQWENQGNVSFAVTRPEQSIAISWPS<br>VSYKAAHKNGSRHKRWANWLTTLPKVVLCFYEDPELCTYGDD<br>WHGGAYKTVAGTPKAITVKQGIEQKTVEQRIHFSKKNAMEAL<br>AAHRVCGVPLETLARSRKPRDLPDDLSCAYQAQNIVSLFVAT<br>RILFSHLDSVFTLNLDEQAPEVAERLSDLRRINEDNPGMVTQ<br>VLTVARQIYNDYVTHHPGLTPEQTSAGAQAADILSLFCPDAD<br>KSCVASNNDQANINIESRSGRSYLPENRAVITPQGVTNWTYQ<br>ELETTHQALTREGYVFVGYHGTNHVAAQTIVNRIAPVPRGNN<br>TENEEKWGGLYVATHAEVAHGYARIKEGTGEYGLPTRAERET<br>RGVMLRVYIPRASLERFYRTNTPLENAEEHITQVIGHSLPLR<br>NEAFTGPESAGGEDETVIGWDMAIHAVAIPS | Naturally<br>occurring<br>Cholix<br>polypeptide |
| SEQ ID NO: 114 | CSLTPEPGKPIQSKLSIPSDVVLDEGVLYYSMTINDEQNDIK<br>DEDKGESIITIGEFATVRATRHYVNQDAPFGVINLDITTENG<br>TKTYSYNRKEGEFAINWLVPIGEDSPASIKISVDELDQQRNI<br>IEVPKLYSIDLDNQTLEQWENQGNVSFAVTRPEQSIAISWPS<br>VSYKAAHKNGSRHKRWANWLTTLPKVVLCFYEDPELCTYGDD<br>WHGGAYKTVAGTPKAITVKQGIEQKTVEQRIHFSKKNAMEAL<br>AAHRVCGVPLETLARSRKPRDLPDDLSCAYQAQNIVSLFVAT<br>RILFSHLDSVFTLNLDEQEPEVAERLSALRQINENNPGMVTQ<br>VLTVARQIYNDYVTHHPGLTPEQTSAGAQAADILSLFCPDAD<br>KSCVASNNDQANINIESRSGRSYLPENRAVITPQGVTNWTYQ<br>ELEATHQALTREGYVFVGYHGTNHVAAQTIVNRIAPVPRGNN<br>TENEEKWGGLYVATHAEVAHGYARIKEGTGNGGLPTRAERET<br>RGVMLRVYIPRASLERFYRTNTPLENAEEHITQVIGHSLPLR<br>NEAFTGPESAGGEDETVIGWDMAIYAVAIPS | Naturally<br>occurring<br>Cholix<br>polypeptide |
| SEQ ID NO: 115 | CSLTPEPGKPIQSKLSIPSDVVLDEGVLYYSMTINDEQNDIK<br>DEDKGESIITIGEFATVRATRHYVNQDAPFGVINLDITTENG<br>TKTYSYNRKEGEFAINWLVPIGEDSPASIKISVDEIDQQRNI<br>IEVPKLYSIDLDNQTLEQWENQGNVSFAVTRPEQSIAISWPS<br>VSYKAAHKNGSRHKRWANWFTTSPKVTLCFYEDPAQCTYGDD<br>WHGGAYKTVAGIPKAITVKQGIEQKTVEQRIHFSKKNAMEAL<br>AAHRVCGVPLETLARSRKPRDLPDDLSCAYQAQNIVSLFVAT<br>RILFSHLDSVFTLNLDEQEPEVAERLSALRQINENNPGMVTQ<br>VLTVARQIYNDYVTHHPGLTPEQTSAGAQAADILSLFCPDAD<br>KSCVASNNDQANINIESRSGRSYLPENRAVITPQGVTNWTYQ<br>ELEATHQALTREDYVFVGYHGTNHVAAQTIVNRIAPVPRGNN<br>TENEEKWGGLYVATHAEVAHGYARIKEGTGEYGLPTRAEQET<br>RGVMLRVYIPRASLERFYRTNTPLENAEEHITQVIGHSLPLR<br>NEAFTGPESAGGEDETVIGWDMAIHAVAIPS | Naturally<br>occurring<br>Cholix<br>polypeptide |
| SEQ ID NO: 116 | CSLTPEPGKPIQSKLSIPSDVVLDEGVLYYSMTINDEQNDIK<br>DEDKGESIITIGEFATVRATRHYVNQDAPFGVIHLDITTENG<br>TKTYSYNRKEGEFAINWLVPIGEDSPASIKISVDELDQQRNI<br>IEVPKLYSIDLDNQTLEQWENQGNVSFAVTRPEQSIAISWPS<br>VSYKAAHKNGSRHKRWANWLTTLPKVVLCFYEEPELCTYGED<br>WHGGAYKTVAGTPGAITVKQGIEQKTVEQRIHFSKGNAMSAL<br>AAHRVCGVPLETLARSRKPRDLTDDLSCAYQAQNIVSLFVAT<br>RILFSHLDSVFTLNLDEQEPEVAERLSALRQINENNPGMVTQ<br>VLTVARQIYNDYVTHHPGLTPEQTSAGAQAADILSLFCPDAD<br>KSCVASNNDQANINIESRSGRSYLPENRAVITPQGVTNWTYQ<br>ELEATHQALTREGYVFVGYHGTNHVAAQTIVNRIAPVPRGNN<br>TENEEKWGGLYVATHAEVAHGYARIKEGTGEYGLPTRAERDA<br>RGVMLRVYIPRASLERFYRTNTPLENAEEHITQVIGHSLPLR<br>NEAFTGPESAGGEDETVIGWDMAIHAVAIPS | Naturally<br>occurring<br>Cholix<br>polypeptide |

TABLE 1-continued

Exemplary Cholix Polypeptide Sequences

| SEQ ID NO | Amino Acid Sequence | Description |
|---|---|---|
| SEQ ID NO: 117 | CSLTPEPGKPIQSKLSIPSDVVLDEGVLYYSMTINDEQNDIK DEDKGESIITIGEFATVRATRHYVNQDAPFGVIHLDITTENG TKTYSYNRKEGEFAINWLVPIGEDSPASIKISVDELDQKRNI IEVPKLYSIDLDNQTLEQWENQGNVSFAVTRPEQSIAISWPS VSYKAAHKNGSRHKRWANWLTTLPKVVLCFYEEPELCTYGED WHGGAYKTVAGTPEAITVKQGIEQKTVEQRIHFSKKNAMEAL AAHRVCGVPLETLARSRKPRDLPDDLSCAYQAQNIVSLFVAT RILFSHLDSVFTLNLDEQEPAVAERLSALRQINENNPGMVTQ VLTVARQIYNDYVTHHPGLTPEQTSAGAQAADILSLFCPDAD KSCVASNNDQANINIESRSGRSYLPENRAVITPQGVTNWTYQ ELEATHQALTREGYVFVGYHGTNHVAAQTIVNRIAPVPRGNN TENEEKWGGLYVATHAEVAHGYARIKEGTGEYGLPTRAERDA RGVMLRVYIPRASLERFYRTNTPLENAEEHITQVIGHSLPLR NEAFTGPESAGGEDETVIGWDMAIHAVAIPS | Naturally occurring Cholix polypeptide |
| SEQ ID NO: 118 | CSLTPEPGKPIQSKLSIPSDVVLDEGVLYYSMTINDEQNDIK DEDKGESIIIIGEFATVRATRHYVNQDAPFGVINLDITTENG TKTYSYNRKEGEFAINWLVPIGEDSPASIKISVDELDQQRNI IEVPKLYSIDLDNQTLEQWENQGNVSFAVTRPEQSIAISWPS VSYKAAHKNGSRHKRWANWLTTLPKVVLCFYEDPELCTYGDD WHGGAYKTVAGTPKAITVKQGIEQKTVEQRIHFSKGNAMSAL AAHRVCGVPLETLARSRKPRDLTDDLSCAYQAQNIVSLFVAT RILFSHLDSVFTLNLDEQEPEVAERLSDLRRINENNPGMVTQ VLTVARQIYNDYVTHHPGLTPEQTSAGAQAADILSLFCPDAD KSCVASNNDQANINIESRSGRSYLPENRVVITPQGVTNWTYQ ELDATHQALTREDYVFVGYHGTNHVAAQTIVNRIAPVPRGNN TENEEKWGGLYVATHAEVAHGYARIKEGTGEYGLPTRAERET RGVMLRVYIPRASLERFYRTNTPLENAEEHITQVIGHSLPLR NEAFTGPESAGGEDETVIGWDMAIHAVAIPS | Naturally occurring Cholix polypeptide |
| SEQ ID NO: 119 | CSLTPEPGKPIQSKLSIPGDVVLDEGVLYYSMTINDEQNDIK DEDKGESIITIGEFATVRATRHYVSQDAPFGVINLDITTENG TKTYSFNRKESEFAINWLVPIGEDSPASIKISIDELDQQRNI IEVPKLYSIDLDNQTLEQWENQGNVSFAVTRPEQSIAISWPS VSYKAAHKNGSRHKRWANWLTTLPEVVLCFFEDPELCTYGDD WHGGAYKTVAGTPKAITVKQGIEQKTVEQRIHFSKKNAMEAL AAHRVCGVPLETLARSRKPRDLPDDLSCAYNAQQIVSLFLAT RILFTHIDSIFTLNLDGQEPEVAERLDDLRRINENNPGMVIQ VLTVARQIYNDYVTHHPGLTPEQTSAGAQAADILSLFCPDAD KSCVASNSDQANINIESRSGRSYLPENRAVITQQGVTNWTYQ ELEATHQALTQEGYVFVGYHGTNHVAAQSIVNRISPVPRGSD TESERAWGGLYVSTDASVAYGYARIQEGTADGGGLTPAERKA RGVMLRVYLPQASLERFYRINADLEKERNLVERVIGHPLPLR NEAFTGTDAEEGSDETAIGWDMAIHGVAIPS | Naturally occurring Cholix polypeptide |
| SEQ ID NO: 120 | CSLTPEPGKPIQSKLSIPGDVVLDEGVLYYSMTINDEQNDIK DEDKGESIITIGEFATVRATRHYVSQDAPFGVINLDITTENG TKTYSFNRKESEFAINWLVPIGEDSPASIKISIDELDQQRNI IEVPKLYSIDLDNQTLEQWENQGNVSFAVTRPEQSIAISWPS VSYKAAHKNGSRHKRWANWLTTLPEVVLCFFEDPELCTYGDD WHGGAYKTVAGTPKAITVKQGIEQKTVEQRIHFSKKNAMEAL AAHRVCGVPLETLARSRKPRDLPDDLSCAYNAQQIVSLFLAT RILFTHIDSIFTLNLDGQEPEVAERLDDLRRINENNPGMVIQ VLTVARQIYNDYVTHHPGLTPEQTSASAQAADILSLFCPDAD KSCVASNSDQANINIESRSGRSYLPENRAVITQQGVTNWTYQ ELEATHQALTQEGYVFVGYHGTNHVAAQSIVNRISPVPRGSD TESERAWGGLYVSTDASVAYGYARIQEGTADGGGLTPAERKA RGVMLRVYLPQASLERFYRINADLEKERNLVERVIGHPLPLR NEAFTGTDAEEGSDETAIGWDMAIHGVAIPS | Naturally occurring Cholix polypeptide |
| SEQ ID NO: 121 | VEDELNIFDECRSPCSLTPEPGKQIQSKLSIPSDVVLDEGVL YYSMTINDEQNDIKDEDKGESIITIGEFATVRATRHYVNQDA PFGVINLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL TDDLSCVYQAQNIVSLFVATRILFSHLDSVFTLNLDEQEPEV AERLSALRQINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEKKWGGLYVATHAEVAHGY ARIKEGTGEYGLPTRAERDARGVMLRV | Naturally occurring Cholix polypeptide |

TABLE 1-continued

Exemplary Cholix Polypeptide Sequences

| SEQ ID NO | Amino Acid Sequence | Description |
|---|---|---|
| SEQ ID NO: 122 | VEDELNIFDECRSPCSLTPEPGKPIQSKLSIPGDVVLDEGVL YYSMTINDEQNDIKDEDKGESIITIGEFATVRATRHYVSQDA PFGVINLDITTENGTKTYSFNRKEGEFAINWLVPIGEDSPAS IKISIDELDQQRNIIEVPKLYSIDLDNQTLEQWETQGNVSFA VTRPEQSIAISWPSVSYKAAEKDGARHKRWAHWHTGLALCWL VPLDAIYNYITQQNCTLGDNWFGGSYETVAGTPKAITVKQGM EQKPVEQRIHFSKKNAMEALAAHRVCGVPLETLARGRKPRDL TDDLQCAYQAQNIVSLFLATRILFSHLDSVFTLNLDEQEPEV AERLTDLRRINENNPGMVTQVLTIARQIYNDYVTEHPGLTPE QTSAGAQAADILSLLCPDADGSCVASNSDQANINIESRSGRS YLPENRAVITPQGVTNWTYQELEAKHQTLTREGYVFVGYHGT NHVAAQSIVNRITPVPRGNNTEKEEEWGG | Naturally occurring Cholix polypeptide |
| SEQ ID NO: 123 | VEDELNIFDECRSPCSLTPEPGKPIQSKLSIPGDVVLDEGVL YYSMTINDEQNDIKDEDKGESIITIGEFATVRATRHYVNQDA PFGVIHLDITTENGTKTYSFNRKEGEFAINWLVPIGEDSPAS IKISIDELDQQRNIIEVPKLYSIDLDNQTLEQWETQGNVSFA VTRPEQSIAISWPSVSYKAAEKDGARHKRWAHWHTGLALCWL VPLDAIYNYITQQNCTLGDNWFGGSYETVAGTPKAITVKQGM EQKPVEQRIHFSKKNAMEALAAHRVCGVPLETLARGRKPRDL TDDLQCAYQAQNIVSLFLATRILFSHLDSVFTLNLDEQEPEV AERLTDLRRINENNPGMVTQVLTIARQIYNDYVTEHPGLTPE QTSAGAQAADILSLFCPDADESCVASNSDQANINIESRSGRS YLPENRAVITPQGVTNWTYQELEAKHQTLTREGYVFVGYHGT NHVAAQSIVNRITPVPRGNNTEKEEEWGG | Naturally occurring Cholix polypeptide |
| SEQ ID NO: 124 | YSIDLDNQTLEQWKTQGNVSFSVTRPEHNIAISWPSVSYKAA QKEGSRHKRWAHWHTGLALCWLVPMDAIYNYITQQNCTLGDN WFGGSYETVAGTPKVITVKQGIEQKPVEQRIHFSNGNAMSAL AAHRVCGVPLETLARSRKPRDLTDDLSCAYQAQNIVSLFVAT RILFSHLDSVFTLNLDEQEPEVAERLSDLRRINENNPGMVTQ VLTVARQIYNDYVTHHPGLTPEQTSAGAQAADILSLFCPDAD KSCVASNNDQANINIESRSGRSYLPENRAVITPQGVTNWTYQ ELEATHQALTREGYVFVGYHGTNHVAAQTIVNRIAPVPRGNN TENEEKWGGLYVATHAEVAHGYARIKEGTGEYGLPTRAERDA RGVMLRVYIPRASLERFYRTNTPLENAEEHITQVIGHSLPLR NEAFTGPESAGGEDETVIGWDMAIHAVAIPSTIPGNAYEELA IDEEAVAKEQSISAKPPYKERKDELK | Naturally occurring Cholix polypeptide |
| SEQ ID NO: 125 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQKRNIIEVPKLYSIDLDNQTLEQWENQGNVSFA VTRPEQSIAISWPSVSYKAAHKNGSRHKRWANWLTTLPKVVL CFYEEPELCTYGEDWHGGAYKTVAGTPEAITVKQGIEQKTVE QRIHFSKKNAMEALAAHRVCGVPLETLARSRKPRDLQDDLSC AYQAQNIVSLFVATRILFSHLDSVFTLNLDEQEPAVAERLSA LRQINENNPGMVTQVLTVARQIYNDYVTHHPGLTPEQTSAGA QAADILSLFCPDADKSCVASNNDQANINIESRSGRSYLPENR AVITPQGVTNWTYQELEATHQALTREGYVFVGYHGTNHV | Naturally occurring Cholix polypeptide |
| SEQ ID NO: 126 | VEEALNIFDECRSPCSLTPEPGKPIQSKLSIPGDVVLDEGVL YYSMTINDEQNDIKDEDKGESIITIGEFATVRATRHYVSQDA PFGVINLDITTENGTKTYSFNRKESEFAINWLVPIGEDSPAS IKISIDELDQQRNIIEVPKLYSIDLDNQTLEQWKTQGNVSFS VTRPEHNIAISWPSVSYKAAQKEGSRHKRWAHWHTGLALCWL VPIDAIYNYITQQNCTLGDNWFGGSYETVAGTPKAITVKQGI EQKPVEQRIHFSKKNAMEALAAHRVCGVPLETLARSRKPRDL PDDLSCAYNAQQIVSLFLATRILFTHIDSIFTLNLDGQEPEV AERLDDLRRINENNPGMVIQVLTVARQIYNDYVTHHPGLTPE QTSAGAQAADILSLFCPDADKSCVASNSDQANINIES | Non-Naturally occurring Cholix polypeptide |
| SEQ ID NO: 127 | LFSHLDSVFTLNLHEQEPAVAERLSALRQINENNPGMVTQVL TVARQIYNDYVTHHPGLTPEQTSAGAQAADILSLFCPDADKS CVASNNDQANINIESRSGRSYLPENRAVITPQGVTNWTYQEL EATHQALTREGYVFVGYHGTNHVAAQTIVNRIAPVPRGNNTE NEEKWGGLYVATHAEVAHGYARIKEGTGEYGLPTRAERDARG VMLRVYIPRASLERFYRTNTPLENAEEHITQVIGHSLPLRNE AFTGPESAGGEDETVIGWDMAIHAVAIPSTIPGNAYEELAID EEAVAKEQSISAKPPYKERKDELK | Naturally occurring Cholix polypeptide |
| SEQ ID NO: 128 | AVITPQGVTNWTYQELEATHQALTREGYVFVGYHGTNHVAAQ TIVNRIAPVPRGNNTENEEKWGGLYVATHAEVAHGYARIKEG TGEYGLPTRAERDARGVMLRVYIPRASLERFYRTNTPLENAE EHITQVIGHSLPLRNEAFTGPESAGGEDETVIGWDMAIHAVA IPSTIPGNAYEELAIDEEAVAKEQSISTKPPYKERKDELK | Naturally occurring Cholix polypeptide |

TABLE 1-continued

Exemplary Cholix Polypeptide Sequences

| SEQ ID NO | Amino Acid Sequence | Description |
|---|---|---|
| SEQ ID NO: 129 | AVITPQGVTNWTYQELEATHQALTREGYVFVGYHGTNHVAAQ TIVNRIAPVPRGNNTENEEKWGGLYVATHAEVAHGYARIKEG TGEYGLPTRAERDARGVMLRVYIPRASLERFYRTNTPLENAE EHITQVIGHSLPLRNEAFTGPESAGGEDETVIGWDMAIHAVA IPSTIPGNAYEELAIDEEAVAKEQSISTKPPYKERKDEL | Naturally occurring Cholix polypeptide |

TABLE 2 provides a consensus sequence (SEQ ID NO: 130, FORMULA I) of Cholix derived polypeptides that can be used as carriers herein.

TABLE 2

| FORMULA I | |
|---|---|
| SEQ ID NO: 130 | X1-E-X3-X4-L-X6-I-F-D-E-C-R-S-P-C-X16-L-T-P-E-X21-G-K-X24-I-Q-S-K-L-X30-I-P-X33-D-V-V-L-D-E-G-V-L-Y-Y-S-M-T-I-N-D-E-Q-N-D-I-X56-D-E-X59-K-G-E-S-I-I-T-X67-G-E-F-A-T-X73-R-A-T-R-H-Y-V-X81-Q-D-A-P-F-G-V-I-X90-L-D-I-T-T-E-N-G-T-K-X101-Y-S-X104-N-R-K-X108-X109-E-F-X112-I-X114-W-L-V-X118-X119-G-E-D-S-P-A-S-I-K-I-S-X131-D-E-X134-D-Q-X137-R-N-I-I-E-V-P-K-L-Y-S-I-D-L-D-N-Q-T-L-E-Q-W-X160-X161-Q-G-N-V-X166-F-X168-V-T-R-P-E-X174-X175-I-A-I-S-W-P-S-V-S-Y-X186-A-A-X189-K-X191-G-X193-R-H-K-R-W-A-X200-W-X202-T-X204-X205-X206-X207-X208-X209-L-X211-X212-X213-X214-X215-X216-X217-X218-X219-X220-X221-X222-X223-X224-C-T-X227-G-X229-X230-W-X232-G-G-X235-Y-X237-T-V-A-G-X242-P-X244-X245-I-X247-V-K-Q-G-X252-E-Q-K-X256-V-E-Q-R-I-H-F-S-X265-X266-N-A-X269-X270-X271-L-A-A-H-R-V-C-G-V-P-L-E-T-L-A-R-X288-R-K-P-R-X293-L-X295-D-D-L-X299-C-X301-Y-X303-A-Q-X306-I-V-S-L-F-X312-A-T-R-X316-L-F-X319-H-X321-D-S-X324-F-T-L-N-L-X330-X331-Q-X333-P-X335-V-X337-E-R-L-X341-X342-X343-R-X345-1-N-E-X349-N-P-G-X353-V-X355-Q-V-L-T-X360-A-R-Q-I-Y-N-D-Y-V-T-X371-H-P-X374-L-X376-P-E-Q-T-S-A-X383-A-Q-A-A-D-I-L-S-L-X393-X394-P-D-X397-D-X399-X400-C-V-A-X404-X405-X406-D-Q-A-N-1-N-X413-E-S-R-S-G-R-S-Y-L-X423-E-N-R-A-V-I-T-X431-Q-G-V-T-N-W-T-Y-Q-E-L-X443-X444-X445-H-Q-X448-L-T-X451-E-X453-Y-V-F-V-G-Y-H-G-T-N-H-X465-A-A-Q-X469-I-V-N-R-I-X475-P-V-P-R-G-X481-X482-T-E-X485-E-X487-X488-W-G-G-X492-Y-V-X495-T-X497-A-X499-X500-X501-X502-X503-Y-X505-R-X507-X508-X509-G-T-X512-X513-X514-X515-X516-X517-T-X519-X520-X521-X522-X523-X524-R-G-V-M-L-X530-V-Y-X533-X534-X535-A-S-L-E-R-F-Y-R-X544-N-X546-X547-L-E-X550-X551-X552-X553-X554-X555-X556-X557-V-I-G-H-X562-L-P-L-R-N-E-A-F-T-G-X573-X574-X575-X576-X577-G-X579-X580-E-T-X583-I-G-W-D-X588-A-I-X591-X592-V-A-I-P-S-T-I-P-G-N-X603-Y-X605-X606-L-X608-X609-X610-E-E-A-X614-A-X616-E-Q-S-I-S-X622-K-P-P-Y-K-E-X629-X630-D-E-L-K; wherein X1 is selected from the group consisting of V and L; X3 is selected from the group consisting of E and D; X4 is selected from the group consisting of A and E; X6 is selected from the group consisting of N and K; X16 is selected from the group consisting of S and L; X21 is selected from the group consisting of P and L; X24 is selected from the group consisting of P and Q; X30 is selected from the group consisting of S and F; X33 is selected from the group consisting of S and G; X56 is selected from the group consisting of K and M; X59 is selected from the group consisting of D and G; X67 is selected from the group consisting of I and F; X73 is selected from the group consisting of V and I; X81 is selected from the group consisting of N and S; X90 is selected from the group consisting of H and N; X101 is selected from the group consisting of T and M; X104 is selected from the group consisting of Y and F; X108 is selected from the group consisting of E and D; X109 is selected from the group consisting of G and S; X112 is selected from the group consisting of A and T; X114 is selected from the group consisting of N and H; X118 is selected from the group consisting of P and I; X119 is selected from the group consisting of I and P; X131 is selected from the group consisting of V and I; X134 is selected from the group consisting L and I; X137 is selected from the group consisting Q and K; X160 is selected from the group consisting K and E; X161 is selected from the group consisting T and N; X166 is selected from the group consisting S and F; X168 is selected from the group consisting S and |

TABLE 2-continued

FORMULA I

A; X174 is selected from the group consisting H and Q; X175 is selected from the group consisting N, S, SIAKQS (SEQ ID NO: 202), and SIAKQSIAKQS (SEQ ID NO: 203); X186 is selected from the group consisting of K and N; X189 is selected from the group consisting of Q, E, and H; X191 is selected from the group consisting of E, N, and D; X193 is selected from the group consisting of S and A; X200 is selected from the group consisting of H and N; X202 is selected from the group consisting of H, L, F, and R; X204 is selected from the group consisting of G and T; X205 is selected from the group consisting of L and S; X206 is selected from the group consisting of A and P; X207 is selected from the group consisting of L, E, and K; X208 is selected from the group consisting of C and V; X209 is selected from the group consisting of W, V, and T; X211 is selected from the group consisting of V and no amino acid; X212 is selected from the group consisting of P and no amino acid; X213 is selected from the group consisting of M, I, L, and no amino acid; X214 is selected from the group consisting of D and no amino acid; X215 is selected from the group consisting of A and no amino acid; X216 is selected from the group consisting of I and no amino acid; X217 is selected from the group consisting of Y and C; X218 is selected from the group consisting of N and F; X219 is selected from the group consisting of Y and F; X220 is selected from the group consisting of I and E; X221 is selected from the group consisting of T and D; X222 is selected from the group consisting of Q and P; X223 is selected from the group consisting of Q, E, and A; X224 is selected from the group consisting of N, L, and Q; X227 is selected from the group consisting of L and Y; X229 is selected from the group consisting of D and E; X230 is selected from the group consisting of N and D; X232 is selected from the group consisting of F, H, and Y; X235 is selected from the group consisting of S and A; X237 is selected from the group consisting of E and K; X242 is selected from the group consisting of T and I; X244 is selected from the group consisting of K, E, and G; X245 is selected from the group consisting of V and A; X247 is selected from the group consisting of T and M; X252 is selected from the group consisting of I and M; X256 is selected from the group consisting of P, T, and A; X265 is selected from the group consisting of K, Q, and N; X266 is selected from the group consisting of G and K; X269 is selected from the group consisting of M and I; X270 is selected from the group consisting of S and E; X271 is selected from the group consisting of A and T; X288 is selected from the group consisting of S and G; X293 is selected from the group consisting of D and Y; X295 is selected from the group consisting of T, P, and Q; X299 is selected from the group consisting of S and Q; X301 is selected from the group consisting of A and V; X303 is selected from the group consisting of Q and N; X306 is selected from the group consisting of N and Q; X312 is selected from the group consisting of V and L; X316 is selected from the group consisting of I and M; X319 is selected from the group consisting of S and T; X321 is selected from the group consisting of L and I; X324 is selected from the group consisting of V and I; X330 is selected from the group consisting of D, E, and H; X331 is selected from the group consisting of E and G; X333 is selected from the group consisting of E and A; X335 is selected from the group consisting of E and A; X337 is selected from the group consisting of A and T; X341 is selected from the group consisting of S, D, and T; X342 is selected from the group consisting of D and A; X343 is selected from the group consisting of L and I; X345 is selected from the group consisting of R and Q; X349 is selected from the group consisting of N and D; X353 is selected from the group consisting of M and V; X355 is selected from the group consisting of T and I; X360 is selected from the group consisting of V and I; X371 is selected from the group consisting of H and E; X374 is selected from the group consisting of G and L; X376 is selected from the group consisting of T and I; X383 is selected from the group consisting of G and S; X393 is selected from the group consisting of F and L; X394 is selected from the group consisting of C and Y; X397 is selected from the group consisting of A and T; X399 is selected from the group consisting of K, E, and G; X400 is selected from the group consisting of S, P, and H; X404 is selected from the group consisting of S and L; X405 is selected from the group consisting of N and D; X406 is selected from the group consisting of N and S; X413 is selected from the group consisting of I and V; X423 is selected from the group consisting of P and L; X431 is selected from the group consisting of P and Q; X443 is selected from the group consisting of E and D; X444 is selected from the group consisting of A and T; X445 is selected from the group consisting of T and K; X448 is selected from the group consisting of A and T; X451 is selected from the group consisting of R and Q; X453 is selected from the group TABLE 2-continued

FORMULA I consisting of G and D; X465 is selected from the group consisting of
V and A; X469 is selected from the group consisting of T, S, and N;
X475 is selected from the group consisting of A, S, and T; X481 is
selected from the group consisting of N and S; X482 is selected from
the group consisting of N and D; X485 is selected from the group
consisting of N, S, and K; X487 is selected from the group consisting
of E, R, and K; X488 is selected from the group consisting of K, A,
and E; X492 is selected from the group consisting of L and V; X495
is selected from the group consisting of A and S; X497 is selected
from the group consisting of H and D; X499 is selected from the
group consisting of E and S; X500 is selected from the group
consisting of V and L; X501 is selected from the group consisting of
A and N; X502 is selected from the group consisting of H and Y;
X503 is selected from the group consisting of G and R; X505 is
selected from the group consisting of A and T; X507 is selected from
the group consisting of I and L; X508 is selected from the group
consisting of K and Q; X509 is selected from the group consisting of
E and K; X512 is selected from the group consisting of G and A;
X513 is selected from the group consisting of E, D, and N; X514 is
selected from the group consisting of Y, G, A, and N; X515 is
selected from the group consisting of G and E; X516 is selected from
the group consisting of L and G; X517 is selected from the group
consisting of P and L; X519 is selected from the group consisting of
R, P, and T; X520 is selected from the group consisting of A and E;
X521 is selected from the group consisting of E and K; X522 is
selected from the group consisting of R, Q, and K; X523 is selected
from the group consisting of D, K, and E; X524 is selected from the
group consisting of A, T, and S; X530 is selected from the group
consisting of R and K; X533 is selected from the group consisting of
I and L; X534 is selected from the group consisting of P and H; X535
is selected from the group consisting of R and Q; X544 is selected
from the group consisting of T and I; X546 is selected from the group
consisting of T, A, and I; X547 is selected from the group consisting
of P and D; X550 is selected from the group consisting of N and K;
X551 is selected from the group consisting of A and E; X552 is
selected from the group consisting of E, R, and D; X553 is selected
from the group consisting of E, N, and R; X554 is selected from the
group consisting of H and L; X555 is selected from the group
consisting of I and V; X556 is selected from the group consisting of
T and E; X557 is selected from the group consisting of Q, R, H, and
D; X562 is selected from the group consisting of S and P; X573 is
selected from the group consisting of P and T; X574 is selected from
the group consisting of E and D; X575 is selected from the group
consisting of S, A, and R; X576 is selected from the group consisting
of A, E, and V; X577 is selected from the group consisting of G, E,
and D; X579 is selected from the group consisting of E and S; X580
is selected from the group consisting of D and N; X583 is selected
from the group consisting of V and A; X588 is selected from the
group consisting of M and I; X591 is selected from the group
consisting of H and Y; X592 is selected from the group consisting of
A and G; X603 is selected from the group consisting of A and S;
X605 is selected from the group consisting of E and A; X606 is
selected from the group consisting of E, A, Q, G, V, and R; X608 is
selected from the group consisting of A, P, and T; X609 is selected
from the group consisting of I, T, and P; X610 is selected from the
group consisting of D and A; X614 is selected from the group
consisting of V and VVKEAI (SEQ ID NO: 204); X616 is selected
from the group consisting of K and E; X622 is selected from the
group consisting of T, A, and P; and X629 is selected from the group
consisting of R, Q, and H; and X630 is selected from the group
consisting of K and no amino acid.

Carriers can include all Cholix derived polypeptides having a reduced or ablated ADP ribosylation activity (e.g., ribosylation of elongation factor 2) relative to a naturally occurring Cholix polypeptide such as one with a sequence of SEQ ID NO: 3. Such carriers can be referred to as non-toxic carriers. Examples of such Cholix derived polypeptides include any of the polypeptides with a sequence set forth in any one of SEQ ID NO: 1-10 that can have a deletion at position 581 (e.g., an E581 deletion as, e.g., in SEQ ID NO: 189), a substitution at position 581 (e.g., a E581A substitution), or an alternative deletion or substitution that renders the carrier non-toxic. In some instances, a carrier has an amino acid sequence of SEQ ID NO: 130 with a mutation at position 581. In some instances, a carrier has an amino acid sequence of any one of SEQ ID NOs: 1-3 with a mutation at position 581.

In some instances, a carrier comprises, consists essentially of, or consists of an amino acid sequence of any one of TABLE 1 or TABLE 2 with a C-terminal deletion, substitution and/or addition thereby resulting in a reduced or ablated ADP ribosylation activity. Such deletion, substitution, and/or addition maintains a transport functionality such as transcytosis or endocytosis. As such, some of the carriers herein transcytose, either alone or along with a heterologous payload, while some of the carriers herein endocytose, either alone, or along with a heterologous payload.

In some instances, a first carrier derived from a first Cholix polypeptide can have improved properties compared to a second carrier derived from a second Cholix polypeptide. Such properties can include the ability of a carrier to transport a heterologous payload across a polarized epithelial cell (or cell layer), a stability of a carrier (e.g., an in vivo stability or an ex vivo stability such as shelf-life), the ability of a carrier to be functionally expressed in an expression system such as E. coli or CHO cells, the ability of a carrier to be purified, e.g., using chromatographical methods, and the ability to multimerize (e.g., dimerize) when, e.g., associated (e.g., coupled) with a heterologous payload. It can surprisingly be shown that a first carrier derived from a Cholix polypeptide having the sequence of SEQ ID NO: 1 can have one or more of the following properties compared to a second carrier derived from a Cholix polypeptide having the sequence of SEQ ID NO: 3 and/or 126: (i) an enhanced transcytosis function (e.g., an increased transport rate for transporting a payload across epithelial cells); (ii) improved functional expression (e.g., higher production yields) in E. coli and/or CHO cells; (iii) improved purification properties (e.g., higher purities and/or recovery yields); and (iv) an enhanced in vivo stability (e.g., an increased protease and/or pH stability, melting temperature). Such in vivo stability can be determined by incubating the carrier with, e.g., Caco-2 cells or by administering (e.g., injecting into a lumen) the carrier to a mammal (e.g., a rodent or a human). Enhanced transcytosis function, e.g., a speed or velocity of transportability can be determined, e.g., as described in EXAMPLE 1 by determining the amount of transported carrier and/or payload in a basolateral chamber at certain time points (e.g., 1, 5, 10, 15, 20, or 30 minutes after apical application of the carrier or delivery construct). In some cases, the stability of a carrier against a protease can be determined by incubating the carrier with the protease (e.g., trypsin) at certain molar ratios (e.g., 1:1) and at ambient temperature, and measuring the amount of intact carrier at various time points (e.g., 5, 10, 15, 30, or 45 minutes) using, e.g., size-exclusion chromatography. The stability of the carrier at a certain pH can be determined by incubating the carrier with a buffer having the appropriate pH (e.g., pH 5.5, 6, 6.5, 7, etc.) and measuring the amount of intact carrier at various time points (e.g., 5, 10, 15, 30 min.) using, e.g., size-exclusion chromatography.

A transcytosing carrier can transport a payload, coupled thereto, across an epithelial cell. Such transport can occur in vitro, e.g., using epithelial cell monolayers such as Caco-2 or SMI-100 cell monolayers. In other instances, such transport can occur in vivo, e.g., across a gut epithelium of a subject (e.g., a rodent or a human) into submucosal compartments such as the lamina propria.

The mechanism of action of a transcytosing carrier can involve one or more of: receptor-mediated endocytosis into a polarized epithelial cell through interaction with TMEM132, LMAN1 and/or GPR75, avoidance of the lysosomal destruction pathway through interaction with GRP75, apical to basal transport through interaction with an ERGIC receptor (e.g., ERGIC-53), and release from the basal membrane into submucosal compartments such as the lamina propria through interaction with perlecan (HSPG).

A transcytosing carrier can be one that interacts with one or more of the following endogenous proteins: TMEM132A, GPR75, ERGIC protein, and perlecan (HSPG) as shown in EXAMPLES 10 and 12. Interaction of a transcytosing carrier with an apical entry receptor such as TMEM132A can enable apical entry of the carrier into a polarized epithelial cell. Interaction of a transcytosing carrier with a lysosome avoidance receptor such as GRP75 can enable the carrier and a payload coupled thereto to avoid lysosomal degradation, thereby allowing transport of unaltered and functionally intact carrier and payload. Interaction of a transcytosing carrier with an apical to basal transport protein such as an ERGIC protein (e.g., ERGIC-53) can allow the carrier, once endocytosed, to move to the basal site of the epithelial cell. Interaction of a transcytosing carrier with a basal release protein such as perlecan can enable the carrier to enter basal recycling systems and exocytosis of the carrier into basolateral compartments, such as submucosal compartments (e.g., lamina propria).

Moreover, a transcytosing carrier can co-localize with any one or more of coating protein I (COPI) early endosome antigen 1 (EEA1) for hijacking the endogenous apical to basal transport machinery, and with Ras-related protein 11a (Rab11a) at the basal side of the epithelial cell for entering basal secretion systems as shown in EXAMPLE 10.

In some instances, a transcytosing carrier does not co-localize with Ras-related protein 7 (Rab7) and/or lysosomal-associated membrane protein 1 (LAMP1) during transport across such epithelial cell, enabling such carrier to avoid lysosomal degradation as shown in EXAMPLE 10.

Examples of transcytosing carriers include those having a C-terminal truncation of any of SEQ ID NOs 1-78 or 130, wherein the C-terminal truncation can occur at the C-terminus of the polypeptide at any amino acid position after the C-terminal residue at position 195 (e.g., truncation at any one of positions 195-634 of SEQ ID NOs: 1-2). Amino acid positions for truncation can be determined using sequence alignment to consensus sequence SEQ ID NO: 130 or any of reference sequences SEQ ID NO: 1, 2 or 3. TABLE 3 below illustrates exemplary carriers by identifying various amino acid residue sequences of such carriers and C-terminal positions that SEQ ID NOs 1-78, or 130 can be truncated at. In some instances, transcytosing carriers include those having a C-terminal truncation of any of SEQ ID NOs 1-2 or 4-78.

TABLE 3

Exemplary Transcytosing Carriers Identifying Amino Acid Residues of any one of SEQ ID NOs: 1-78 or 130

| AA residues |
|---|
| 1-195 |
| 1-196 |
| 1-197 |
| 1-198 |
| 1-199 |
| 1-200 |
| 1-201 |
| 1-202 |
| 1-203 |
| 1-204 |
| 1-205 |
| 1-206 |
| 1-207 |
| 1-208 |
| 1-209 |
| 1-210 |
| 1-211 |
| 1-212 |
| 1-213 |
| 1-214 |
| 1-215 |
| 1-216 |
| 1-217 |
| 1-218 |
| 1-219 |

TABLE 3-continued Exemplary Transcytosing Carriers Identifying Amino Acid Residues of any one of SEQ ID NOs: 1-78 or 130

| AA residues |
|---|
| 1-220 |
| 1-221 |
| 1-222 |
| 1-223 |
| 1-224 |
| 1-225 |
| 1-226 |
| 1-227 |
| 1-228 |
| 1-229 |
| 1-230 |
| 1-231 |
| 1-232 |
| 1-233 |
| 1-234 |
| 1-235 |
| 1-236 |
| 1-237 |
| 1-238 |
| 1-239 |
| 1-240 |
| 1-241 |
| 1-242 |
| 1-243 |
| 1-244 |
| 1-245 |
| 1-246 |
| 1-247 |
| 1-248 |
| 1-249 |
| 1-250 |
| 1-251 |
| 1-252 |
| 1-253 |
| 1-254 |
| 1-255 |
| 1-256 |
| 1-257 |
| 1-258 |
| 1-259 |
| 1-260 |
| 1-261 |
| 1-262 |
| 1-263 |
| 1-264 |
| 1-265 |
| 1-266 |
| 1-267 |
| 1-268 |
| 1-269 |
| 1-270 |
| 1-271 |
| 1-272 |
| 1-273 |
| 1-274 |
| 1-275 |
| 1-276 |
| 1-277 |
| 1-278 |
| 1-279 |
| 1-280 |
| 1-281 |
| 1-282 |
| 1-283 |
| 1-284 |
| 1-285 |
| 1-286 |
| 1-287 |
| 1-288 |
| 1-289 |
| 1-290 |
| 1-291 |
| 1-292 |
| 1-293 |
| 1-294 |
| 1-295 |
| 1-296 |
| 1-297 |
| 1-298 |
| 1-299 |
| 1-300 |
| 1-301 |
| 1-302 |
| 1-303 |
| 1-304 |
| 1-305 |
| 1-306 |
| 1-307 |
| 1-308 |
| 1-309 |
| 1-310 |
| 1-311 |
| 1-312 |
| 1-313 |
| 1-314 |
| 1-315 |
| 1-316 |
| 1-317 |
| 1-318 |
| 1-319 |
| 1-320 |
| 1-321 |
| 1-322 |
| 1-323 |
| 1-324 |
| 1-325 |
| 1-326 |
| 1-327 |
| 1-328 |
| 1-329 |
| 1-330 |
| 1-331 |
| 1-332 |
| 1-333 |
| 1-334 |
| 1-335 |
| 1-336 |
| 1-337 |
| 1-338 |
| 1-339 |
| 1-340 |
| 1-341 |
| 1-342 |
| 1-343 |
| 1-344 |
| 1-345 |
| 1-346 |
| 1-347 |

Such transcytosing carriers can further be truncated at their N-terminus at an amino acid position up to N-terminal position 20 (e.g., SEQ ID NO: 79 which is truncated at the N-terminal position 17 (starts with position 18)).

Also contemplated herein are transcytosing carriers such having at least about 80%, 85%, 90%, 95%, 98% or 99% sequence identity, to any of the carrier sequences shown in TABLE 3.

In one instance the carrier comprises SEQ ID NO: 1 with a C-terminal truncation at position 386. In one instance the carrier comprises SEQ ID NO: 2 with a C-terminal truncation at position 386. In one instance the carrier comprises SEQ ID NO: 4-79 with a C-terminal truncation at position 386. In one instance the carrier comprises SEQ ID NO: 130 with a C-terminal truncation at position 386. In such instances, the sequence does not include SEQ ID NO: 3 with a C-terminal truncation at position 386. In such instances, the sequence does not include SEQ ID NO: 126.

When a Cholix derived carrier has a C-terminal truncation at position 386, it can be referred to herein as Cholix$^{386}$. The "386" designates the C-terminal truncation after the amino acid that most closely aligns with position 386 when the sequence is part of or aligned with SEQ ID NO: 130. A cholix$^{386}$ does not necessitate that the polypeptide has 386 amino acids in it. For example, a truncation of SEQ ID NO: 79 at position 386 results in a carrier that is shorter than 386 amino acid residues. Examples of Cholix$^{386}$ carrier molecules include any one of SEQ ID NOs: 1-79 or 130 truncated at position 386 as it is aligned for the highest sequence identity with SEQ ID NO 130 or it is aligned with any of SEQ ID NOs: 1-3 for highest sequence identity, e.g., ending with the amino acid residues "AQA."

A Cholix$^{386}$ can also include polypeptides maintaining substantially the same function as SEQ ID NO: 180 but with one or more additions/deletion/substitutions, and having at least 70%, 80%, 90%, 95%, 96%, 97%, 98%, or 99% sequence identity to the Cholix$^{386}$ molecules described herein.

Another example of a transcytosing Cholix derived carrier is Cholix$^{266}$. In one instance, a Cholix$^{266}$ consists of an amino acid sequence of SEQ ID NO: 181. Other Cholix$^{266}$ fragments can include those of any of SEQ ID NO: 1-78 truncated at amino acid position 266 as it is aligned for the highest sequence identity with SEQ ID NO 130 or it is aligned with any of SEQ ID NOs 1-3 for highest sequence identity. Alternatively, a carrier can have any sequence of FORMULA I (SEQ ID NO: 130) truncated at the C-terminus at position 266.

Another example of a transcytosing Cholix derived carrier is Cholix$^{251}$. In one instance, a Cholix$^{251}$ consists of an amino acid sequence of SEQ ID NO: 182. Other Cholix$^{251}$ fragments can include those of any of SEQ ID NO: 1-78 truncated at amino acid position 251 as it is aligned for the highest sequence identity with SEQ ID NO 130 or it is aligned with any of SEQ ID NOs 1-3 for highest sequence identity. Alternatively, a carrier can have any sequence of FORMULA I (SEQ ID NO: 130) truncated at the C-terminus at position 251.

Another example of a transcytosing Cholix derived carrier is Cholix$^{245}$. In one instance, a Cholix$^{245}$ consists of an amino acid sequence of SEQ ID NO: 183. Other Cholix$^{245}$ fragments include those of any of SEQ ID NO: 1-79 truncated at amino acid position 245 as it is aligned for the highest sequence identity with SEQ ID NO 130 or it is aligned with any of SEQ ID NOs 1-3 for highest sequence identity. Alternatively, a carrier can have any sequence of FORMULA I (SEQ ID NO: 130) truncated at the C-terminal at position 245.

Another example of a transcytosing Cholix derived carrier is Cholix$^{206}$. In one instance, a Cholix$^{206}$ consists of an amino acid sequence of SEQ ID NO: 184. Other Cholix$^{206}$ fragments include those of any of SEQ ID NO: 1-78 truncated at amino acid position 206 as it is aligned for the highest sequence identity with SEQ ID NO 130 or it is aligned with any of SEQ ID NOs 1-3 for highest sequence identity. Alternatively, a carrier can have any sequence of FORMULA I (SEQ ID NO: 130) truncated at the C-terminal at position 206.

Other examples of carriers include those having a C-terminal truncation at any one of amino acid position 195-634 of the sequence set forth in FORMULA I (SEQ ID NO: 130). Preferably, such truncation is at an amino acid position of any one of 195-347 of the sequence set forth in FORMULA I (SEQ ID NO: 130).

At the N-terminus, a transcytosing carrier can have any of amino acids 1-20 of SEQ ID NOs: 1-78, or 130. In some embodiments, the N-terminus of the carrier has amino acid residues 1-20 of SEQ ID NO: 1 or 2 (100% sequence identity at positions 1-20), or an amino acid sequence having at least about 80%, 85%, 90%, 95%, 98% or 99% sequence identity to amino acid residues 1-20 of SEQ ID NO: 1 or 2. In some embodiments, the first four amino acids at the N-terminus are VEEA (SEQ ID NO: 185). In some embodiments, such carrier does not comprise SEQ ID NO: 126. In some embodiments, the N-terminus of the carrier has the amino acid residues 1-20 of FORMULA I (SEQ ID NO: 130). Any of such carrier can optionally have an N-terminal modification as described herein. Such N-terminal modification can be an N-terminal methionine. Examples of such carriers are those comprising, consisting essentially of, or consisting of an amino acid sequence set forth in any one of SEQ ID NOs: 131-135.

As such, a transcytosing carrier can comprise, consist essentially of, or consist of an amino acid sequence having at least about 80%, 85%, 90%, 95%, 98% or 99% sequence identity, or have 100% sequence identity, to the amino acid residues from position 1 to any of the amino acid residues at any one of the positions 205-275 of the amino acid sequence set forth in FORMULA I (SEQ ID NO: 130).

In such instances, a transcytosing carrier consists, consists essentially of, or comprises amino acid residues 1-275, 1-266, 1-265, 2-265, 3-265, 4-265, 5-265, 1-251, 1-250, 2-250, 3-250, 4-250, 5-250, 1-245, 2-245, 3-245, 4-245, 5-245, 1-206, 1-205, 2-205, 3-205, 4-205, or 5-205 of the amino acid residues set forth in FORMULA I (SEQ ID NO: 130). In various instances, such carrier can consist or consist essentially of amino acid residues 1-275, 1-266, 1-265, 2-265, 3-265, 4-265, 5-265, 1-251, 1-250, 2-250, 3-250, 4-250, 5-250, 1-245, 2-245, 3-245, 4-245, 5-245, 1-206, 1-205, 2-205, 3-205, 4-205, or 5-205 of the same amino acid residues set forth in any one of SEQ ID NOs: 1-78.

Specifically, in some instances, such transcytosing carrier can comprise, consist essentially of, or consist of the amino acid residues 1-275, 1-266, 1-265, 2-265, 3-265, 4-265, 5-265, 1-251, 1-250, 2-250, 3-250, 4-250, 5-250, 1-245, 2-245, 3-245, 4-245, 5-245, 1-206, 1-205, 2-205, 3-205, 4-205, or 5-205 of the amino acid sequence set forth in SEQ ID NO: 1.

Alternatively, in some instances, such transcytosing carrier can comprise, consist essentially of, or consist of the amino acid residues 1-275, 1-266, 1-265, 2-265, 3-265, 4-265, 5-265, 1-251, 1-250, 2-250, 3-250, 4-250, 5-250, 1-245, 2-245, 3-245, 4-245, 5-245, 1-206, 1-205, 2-205, 3-205, 4-205, or 5-205 of the amino acid sequence set forth in SEQ ID NO: 2.

A carrier can be further modified at its N-terminus. Such N-terminus modifications include functional groups that can enhance expression and/or stability of the polypeptide. Such terminal modifications can be illustrated by the following designation "FG-Carrier", wherein FG is a functional group attached to the N-terminus of the carrier. Examples of functional groups contemplated herein include a methionine for bacterial expression and other signal sequences for expression in CHO cells or HEK-293 cells. Examples of transcytosing carriers with an N-terminal methionine include those having an amino acid sequence set forth in any one of SEQ ID NOs: 131-135 (TABLE 4). It should be noted that functional groups can also be coupled to the C-terminus of a carrier.

TABLE 4

Exemplary Transcytosing Cholix Derived Carriers

| SEQ ID NO | Sequence |
|---|---|
| SEQ ID NO: 131 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLA |
| SEQ ID NO: 132 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKV |
| SEQ ID NO: 133 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQG |
| SEQ ID NO: 134 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKG |
| SEQ ID NO: 135 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQA |
| SEQ ID NO: 184 | VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLA |
| SEQ ID NO: 183 | VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKV |
| SEQ ID NO: 182 | VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQG |
| SEQ ID NO: 181 | VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKG |
| SEQ ID NO: 180 | VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQA |
| SEQ ID NO: 178 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSK |
| SEQ ID NO: 191 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESCENLFQ |
| SEQ ID NO: 192 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQACENLFQ |
| SEQ ID NO: 193 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESCENLFQSGTCHHHHHH |
| SEQ ID NO: 194 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQACENLFQSGTCHHHHHH |

Using crystal structure information of a Cholix derived carrier having an amino acid sequence of SEQ ID NO: 178, a handful of regions were identified that can play a role in endocytosis and transcytosis. Such regions are referred to herein as $X_1$, $X_2$, $X_3$, $X_4$, $X_5$. $X_1$ spans amino acid residues 17-25, has an amino acid sequence of SEQ ID NO: 160, and can play a role in apical to basal transport of a carrier, e.g., by allowing interaction of a carrier with an ERGIC protein (e.g., ERGIC-53). $X_2$ spans amino acid residues 170-176, has an amino acid sequence of SEQ ID NO: 161, and can play a role in carrier access to supranuclear compartments and to move from the apical to the basal site of an epithelial cell, e.g., by allowing interaction of a carrier with an ERGIC protein. $X_3$ spans amino acid residues 186-202, has an amino acid sequence of SEQ ID NO: 162, and can play a role in basal release of the carrier into basolateral compartments, e.g., by allowing interaction of a carrier with a basal release protein such as perlecan. $X_4$ spans amino acid residues 31-39, has an amino acid sequence of SEQ ID NO: 163, and can play a role in carrier movement from the apical site an epithelial cell to the basal site, e.g., by allowing interaction of a carrier with an ERGIC protein. $X_5$ spans amino acid residues 135-139, has an amino acid sequence of SEQ ID NO: 164, and can play a role in apical entry of a carrier into an epithelial cell, e.g., by allowing interaction of a carrier with an apical entry receptor such as TMEM132.

Thus, in some embodiments, a transcytosing carrier includes the amino acid residues of any one of SEQ ID NOs: 1-78, or 130 at $X_1$, $X_2$, $X_3$, $X_4$, and/or $X_5$. For example, a carrier herein can have amino acids 1-266 of SEQ ID NO: 1 or 2, or a sequence having at substantial sequence identity thereto; provided however that any one or more of $X_1$, $X_2$, $X_3$, $X_4$, and $X_5$ are identical to those of SEQ ID NO: 1 or 2. In one embodiment, all of $X_1$, $X_2$, $X_3$, $X_4$, $X_5$ are identical to those of SEQ ID NO: 1 or 2. The same can be said for all other carriers and Cholix-derived carriers described herein, such as those provided in TABLE 3 or TABLE 4.

In some embodiments, transcytosing carriers exclude those having a sequence of any one or more of the Cholix sequence polypeptides set forth in SEQ ID NOs: 1-78 or 130. In some instances, those polypeptides are excluded that have a sequence set forth in SEQ ID NO: 3 or a truncated SEQ ID NO: 3 with a C-terminal truncation at residue 425-348, 291, 266, 265, 251, 250, 245, 244, 234, 206, 205, 187, 186, 151, 150, 134, 133 as well as the fragment consisting of residues 40-187 of SEQ ID NO: 3. In some embodiments, transcytosing carriers exclude those comprising, consisting essentially, or consisting of a sequence of SEQ ID NO: 126.

Surprisingly, it has also been identified that carriers shorter than the transcytosing carriers can transport a heterologous payload into a polarized epithelial cell without significant transport of such payload across the epithelial cell. Such carriers can be referred to herein as “endocytosing carriers”. Endocytosing carriers can end up in an intracellular vesicle or cytosol of the epithelial cell.

Examples of endocytosing carriers include those having amino acid residues from any one of the positions 1-40 to any one of the positions 145-194 of FORMULA I (SEQ ID NO: 130). In some embodiments, an endocytosing carrier has an amino acid sequence of any of SEQ ID NOs: 1-80 or 82-120, having a C-terminal truncation at any one of the amino acid positions of 145-194.

Moreover, any of the endocytosing carriers can further have an N-terminal truncation. Such N-terminal truncation can remove up to 40 amino acids from the N-terminus of the carrier. For example, contemplated herein are carriers having amino acids VLYY (SEQ ID NO: 186) or GVLYY (SEQ ID NO: 187) at the N-terminus which is representative of amino acid position 41-44 and 40-44 of SEQ ID NO: 130, respectively. In some instances, a carrier comprises a higher degree of sequence disparity at positions 1-40 as compared to amino acids 41 to a C terminus (e.g., a C-terminus at an amino acid residue selected from positions 145-194) of the amino acid sequence set forth in any one of SEQ ID NOs: 1-80 or 82-120, or SEQ ID NO: 130. A carrier most preferably comprises, consists essentially of, or consists of the amino acid residues from any one of the positions 1-20 to any one of the positions 150-187, or from any one of the amino acid residues at positions 21-41 to the amino acid residue at position 187 or 205 of the amino acid sequence set forth in FORMULA I (SEQ ID NO: 130). TABLE 5 provides exemplary amino acid residues that an endocytosing carrier can comprise, consist essentially of, or consist of

TABLE 5

Exemplary Amino Acid Residues of Cholix Carriers of any one of SEQ ID NOs: 1-78 or 130

| Cholix AA residues |
|---|
| 1-150 |
| 1-151 |
| 1-152 |
| 1-153 |
| 1-154 |
| 1-155 |
| 1-156 |
| 1-157 |
| 1-158 |
| 1-159 |
| 1-160 |
| 1-161 |
| 1-162 |
| 1-163 |
| 1-164 |
| 1-165 |
| 1-166 |
| 1-167 |
| 1-168 |
| 1-169 |
| 1-170 |
| 1-171 |
| 1-172 |
| 1-173 |
| 1-174 |
| 1-175 |
| 1-176 |
| 1-177 |
| 1-178 |
| 1-179 |
| 1-180 |
| 1-181 |
| 1-182 |
| 1-183 |
| 1-184 |
| 1-185 |
| 1-186 |
| 1-187 |
| 22-187 |
| 23-187 |
| 24-187 |
| 25-187 |
| 26-187 |
| 27-187 |
| 28-187 |
| 29-187 |
| 30-187 |
| 31-187 |
| 32-187 |
| 33-187 |
| 34-187 |
| 35-187 |
| 38-187 |
| 39-187 |
| 40-187 |
| 41-187 |

In some instances, such carrier has an N-terminal truncation at position 39 of FORMULA I (SEQ ID NO: 130). In other instances, such carrier has an N-terminal truncation at position 40 of FORMULA I (SEQ ID NO: 130). When such carrier is also truncated at its C-terminus at any one of the amino acid residues at positions 145-206 (i.e., having the C-terminal residue of any one of residues 145-206) of the sequence set forth in FORMULA I (SEQ ID NO: 130), such carrier can be used for endocytosis of a payload into an epithelial cell and transporting such payload to apical compartment(s) of such epithelial cell (see, e.g., EXAMPLE 4). Any of these endocytosing carriers described herein can also comprise an N-terminal modification such as an N-terminal methionine. Examples of such carrier are those comprising, consisting essentially of, or consisting of the amino acid residues 41-187 of SEQ ID NO: 1 (SEQ ID NO: 137), or of the amino acid residues 40-205 of SEQ ID NO: 1 (SEQ ID NO: 138).

In some embodiments, an endocytosing carrier can comprise, consist essentially of, or consist of the amino acid residues 1-150 of any of the sequences set forth in SEQ ID NOs: 1-78, or 130. In some embodiments, an endocytosing carrier can comprise, consist essentially of, or consist of the amino acid residues 1-151 of any of the sequences set forth in SEQ ID NOs: 1-78, or 130. In some embodiments, an endocytosing carrier can comprise, consist essentially of, or consist of the amino acid residues 1-186 of any of the sequences set forth in SEQ ID NOs: 1-78, or 130. In some embodiments, an endocytosing carrier can comprise, consist essentially of, or consist of the amino acid residues 1-187 of any of the sequences set forth in SEQ ID NOs: 1-78, or 130. In one instance, the carrier has amino acids 1-150, 1-151, 1-186, or 1-187 of SEQ ID NO: 1. In another instance, the carrier has amino acids 1-150, 1-151, 1-186, 1-187 of SEQ ID NO: 2.

Any of the endocytosing carriers herein can have a functional group (such as a methionine) attached to their N-terminus. Examples of endocytosing carriers with an N-terminal methionine include those with sequences set forth in any one of SEQ ID NOs: 136 or 139.

In other cases, such endocytosing carrier comprises the amino acid residues from position 40 or 41 to any one of the amino acid residues at positions 187-206 of the amino acid sequence set forth in FORMULA I (SEQ ID NO: 130).

In such instances, an endocytosing carrier can comprise, consist essentially of, or consist of the amino acid residues 40-187 or 41-187 of any one of the sequences set forth in SEQ ID NOs: 1-80, 82-120, or 130. In other instances, a carrier capable of transporting a heterologous payload into a polarized epithelial cell can comprise, consist essentially of, or consist of the amino acid residues 40-205 or 41-205 of any one of the sequences set forth in SEQ ID NOs: 1-80, 82-120, or 130.

Such carrier can comprise, consist essentially of, or consist of the amino acid residues 40-187, 41-187, 40-205, or 41-205 of SEQ ID NO: 1. Exemplary amino acid sequences of such carriers include those that consist of, consist essentially of, or comprise an amino acid sequence set forth in SEQ ID NOs: 137 and 138. Such carriers can be capable of transporting a payload to an apical compartment of a polarized epithelial cell, but not to a basal compartment as those carriers lack amino acid residues 1-39 that can play a role in apical to basal transport.

An endocytosing carrier can comprise the endocytosis fragment that consists of the amino acid residues from position 134 to position 151 of the amino acid sequence set forth in Formula I (SEQ ID NO: 130). In some cases, such functional fragment has the sequence set forth in SEQ ID NO: 165, or a high (e.g., >90%) sequence identity thereto. Exemplary carriers include those that can consist of, consist essentially of, or comprise an amino acid sequence set forth in any one of SEQ ID NOs: 136-139 (TABLE 6). Carriers that lack one or both functional fragments with SEQ ID NOs: 166-167 (TABLE 11) can transport heterologous payload to apical compartments of epithelial cells that can include locations in apical vesicles, in the apical cytosol of the cell, and/or in the apical recycling systems such as apical recycling endosomes. Such carrier can interact with an apical entry receptor such as TMEM132 (e.g., TMEM132A), but not or not significantly with basal trafficking proteins or perlecan (HSPG) and can co-localize with Rab11a in apical compartments of the epithelial cell following endocytosis. In some instances, such carrier can consist of, consist essentially of, or comprise an amino acid sequence set forth in any one of SEQ ID NOs: 137-139 (TABLE 6).

TABLE 6

Exemplary Endocytosing Cholix Derived Carriers

| SEQ ID NO | Sequence |
|---|---|
| SEQ ID NO: 136 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKA |
| SEQ ID NO: 137 | MVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKA |
| SEQ ID NO: 138 | MGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGL |
| SEQ ID NO: 139 | MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDL |

In other embodiments, an endocytosing carrier can comprise the functional fragments that consist of the amino acid residues from position 1 to position 40 and position 152 to position 187, respectively, of the amino acid sequence set forth in FORMULA I (SEQ ID NO: 130). In some cases, such fragments have the amino acid sequences set forth in SEQ ID NO: 166 and 167, respectively, or a high (e.g., >90%) sequence identity to one or both of such functional fragments. Such carrier can interact with an apical to basal trafficking receptor, but not significantly with perlecan. Such trafficking receptor enables such carrier to transport a payload to a supranuclear and/or a basal compartment of a polarized epithelial cell. Such carrier can consist of, consist essentially of, or comprise amino acids 1-187 of SEQ ID NO: 130. An example of such carrier is one that has the sequence set forth in SEQ ID NO: 136.

In some instances, an endocytosing carrier is not a fragment of the sequence set forth in SEQ ID NO: 3. In some instances, such carrier is not a fragment of any one of the sequences set forth in SEQ ID NOs: 4-80, or 82-120. In such instances, a carrier does not comprise or consist of amino acid residues 1-151, 1-187, or 40-187 of SEQ ID NO: 3.

D. Functional Sequence Regions of Carriers

In any of the embodiments herein, one or more functional sequence region(s) within a carrier sequence can have a localized high (e.g., >90%) sequence identity to the amino acid residues found in those regions in FORMULA I (SEQ ID NO: 130) in order to maintain functionality across numerous polypeptides and embodiments. In some cases, the amino acid residues in those region(s) can be restricted to those found in naturally occurring Cholix polypeptides such as those having the sequence set forth in any one of SEQ ID NOs: 1-80 or 82-120.

1. Endocytosing Domain

In some instances, a carrier comprises a domain that allows the carrier to enter an epithelial cell (e.g., a polarized epithelial cell) on the apical site. In some instances, such domain allows the carrier to interact with an apical entry receptor. Such apical entry receptor can be TMEM132 or TMEM132A. Such TMEM132 interacting domain may have a consensus sequence of amino acid residues 135-151 of FORMULA I (SEQ ID NO: 130) or of amino acid residues of positions 135-151 of any of SEQ ID NOs: 1-120. TMEM132A is a transmembrane protein that is responsible for apical entry of a carrier into an epithelial cell. In order to maintain carrier interaction with TMEM132A, in some embodiments, a carrier herein includes a SEQ ID NO: 165 which sets forth a consensus sequence for a TMEM132A interacting domain. Alternatively, a carrier herein can include the amino acid residues 135-151 of any one or more of SEQ ID NOs: 1-120, or 130 as its TMEM132 interacting domain.

Moreover, it is surprisingly assumed that subregions within the TMEM132 interacting domain may be particularly relevant for apical entry of the carrier. Thus, a carrier herein may interact with an apical entry receptor such as TMEM132 via an interacting region with an amino acid motif having amino acid residues 135-139 of SEQ ID NO: 130 (e.g., "DQQRN" of SEQ ID NO: 1; SEQ ID NO: 164). Thus, any of the carriers herein (including polypeptides thereof) may include such motif, or the entire TMEM132 interacting domain (e.g., SEQ ID NO: 165) in order to provide entry into the epithelial cells on the apical side. As such regions can have functions within the carrier, the amino acid sequences in such regions may be conserved, or has only up to 1, 2, or 3, amino acid residues that are substitutions, insertions, and/or deletions.

Any of the carriers herein may include a TMEM132 interacting domain or receptor interacting regions in order to enter the epithelial cell. For example, a carrier comprising amino acid residues 1-151 of SEQ ID NO: 1, which includes a TMEM132 interacting domain of SEQ ID NO: 165 can enter epithelial cells on the apical side. Similarly, a Cholix[266] carrier, such as a carrier comprising amino acid residues 1-266 of SEQ ID NO: 1 (e.g., SEQ ID NO: 181), includes the TMEM132 domain and can both enter the apical side of the epithelial cells via the TMEM132 domain and transport a heterologous payload across a polarized epithelial cell. Other exemplary carriers comprising a TMEM132 interacting domain are Cholix[187], Cholix[206], Cholix[245], Cholix[251], and Cholix[386] (e.g., SEQ ID NOs: 136, and 180-184). In some instances, a carrier is one having amino acid residues 1-187, 1-206, 1-245, 1-251, 1-266, or 1-386 of SEQ ID NO: 1.

On the other hand, a carrier lacking a TMEM132 interacting domain, such as M-Cholix[134] having SEQ ID NO: 140 can remain in the intestinal lumen and does not, or does not significantly (e.g., less than 10% of carrier material that was applied to the apical surface), enter an epithelial cell (see, e.g., EXAMPLE 6).

2. Supranuclear and Basal Compartment Targeting Domains

In some instances, a carrier comprises N-terminal amino acid residues 1-40 of the sequence set forth in FORMULA I (SEQ ID NO: 130). Such carrier can be used to transport a heterologous payload from an apical to a supranuclear or basal compartment (and into submucosal compartments, if such carrier can also interact with a basal release protein such as perlecan) of an epithelial cell following endocytosis of the carrier into the cell. Examples of such carriers include those comprising amino acid sequences set forth in SEQ ID NOs: 131-135 (TABLE 4).

In some instances, a carrier comprises amino acid residues 17-25 and/or 31-39 of the sequence set forth in FORMULA I (SEQ ID NO: 130). Such regions can be restricted to those amino acid residues found in a naturally occurring Cholix polypeptide or include up to 1, 2, 3, or 4 amino acid substitutions, insertions, and/or deletions. The substitution(s) can be one or more conservative or non-conservative substitutions. The 1, 2, 3, or 4 amino acid substitutions, insertions and/or deletions can preserve a function of amino acids 17-25 and/or 31-39. In some instance, a carrier has a naturally occurring sequence at 17-25 and/or 31-39. In such instances, amino acids 17-25 of a carrier can have the sequence of SEQ ID NO: 160, and/or amino acids 31-39 of the carrier can have the sequence of SEQ ID NO: 163. The function of amino acids 17-25 and 31-39 can be apical to basal transport. Such function can be determined as described elsewhere herein, e.g., by generating carriers comprising N-terminal truncations at such residues and compare to the apical to basal transport capabilities of these carrier to those that do not have an N-terminal truncation (see, e.g., EXAMPLES 5 and 6). Exemplary carriers comprising such regions and being capable of apical to supranuclear and/or basal transport can comprise, consist essentially of, or consist of amino acid residues 1-187, 1-206, 1-245, 1-251, 1-266, and 1-386 of the sequence set forth in SEQ ID NO: 1. In such cases, a carrier can consist of the amino acid sequence set forth in any one of SEQ ID NOs: 131-136.

In some instances, a carrier uses an additional domain to access supranuclear and/or basal compartment. Such domain can have a consensus sequence of amino acid residues 152-187 of FORMULA I (SEQ ID NO: 130) or of amino acid residues of positions 152-187 of any of SEQ ID NOs: 1-120. The function of this domain can be to access supranuclear regions within an epithelial cell, reach basal compartments within an epithelial cell, and/or for co-localization of the carrier with elements of the trans-Golgi network such as coating protein I (COPI).

For example, carriers such as Cholix[187] or Cholix[206], e.g., carriers with sequence set forth in SEQ ID NOs: 136 and 131, respectively, which include such supranuclear and basal targeting region are capable of accessing supranuclear regions and basal compartments within an epithelial cell, whereas a carrier without such domain, such as a Cholix[151] (e.g., SEQ ID NO: 139) remains at the apical side of the epithelial cell and does not significantly access supranuclear regions or basal compartments (see, e.g., EXAMPLE 6).

It is believed that sequence of amino acid residues 170-176 of SEQ ID NO: 130 (e.g., "TRPEHNI," SEQ ID NO: 161) may be of particular relevance for a carrier to access such supranuclear and basal compartments and co-localize with COPI.

Hence, in some instances, a carrier comprises a supranuclear and basal targeting domain, or consensus sequence of amino acid residues 170-176 of Formula I (SEQ ID NO:

130), or SEQ ID NO: 161 (corresponding to amino acid residues 170-176 of SEQ ID NO: 1). Such carrier can also include a TMEM132A interacting domain as described above.

The supranuclear and basal targeting domain is one that can have minimal sequence variations. As such, a carrier herein can comprise a supranuclear and basal targeting domain that has amino acid residues of naturally occurring polypeptides such as those with SEQ ID NOs: 3-120, or can comprise only up to 1, 2, or 3, amino acid residues that are substitutions, insertions, and/or deletions relative to the residues of naturally occurring polypeptides such as those with SEQ ID NOs: 3-120.

Exemplary carriers comprising a supranuclear targeting domain are Cholix[187], Cholix[206], Cholix[245], Cholix[251], Cholix[266] and Cholix[386]. In some instances, a carrier is one having amino acid residues 1-187, 1-206, 1-245, 1-251, 1-266, or 1-386 of SEQ ID NO: 1.

3. Transcytosis Domain

In some instances, a carrier comprises a transcytosis domain. Such domain preferably can include a consensus sequence of amino acid residues 188-206 of FORMULA I (SEQ ID NO: 130) or of amino acid residues of positions 188-206 of any of SEQ ID NOs: 1-120. The function of amino acid residues 188-206 can be multifold and can play a role in transcytosis. The transcytosis region can allow interaction of a carrier with transport receptor like interaction partners (also referred to herein as "TRIPs"), endoplasmic reticulum Golgi intermediate compartment 53 (ERGIC-53, also referred to herein as LMAN1), glucose-regulated protein 75 (GRP75), and perlecan in a pH-dependent and/or sequential manner. Such interactions can allow the carrier to access basal recycling systems that release the carrier (along with any heterologous payload coupled thereto) from the basal membrane of the epithelial cell into the basolateral compartment (e.g., lamina propria).

Examples of carriers capable of transcytosis include Cholix derived carriers such as $Cholix^{206}$, $Cholix^{245}$, $Cholix^{251}$, $Cholix^{266}$, and $Cholix^{386}$. In some instances, such carriers have an amino acid sequence of those with amino acid residues 1-206, 1-245, 1-251, 1-266, and 1-386 of SEQ ID NO: 130. In some instances, such carriers have an amino acid sequence of those with amino acid residues 1-206, 1-245, 1-251, 1-266, and 1-386 of SEQ ID NO: 1. In some instances, such carriers have an amino acid sequence of those with amino acid residues 1-206, 1-245, 1-251, 1-266, and 1-386 of SEQ ID NO: 2. Examples of such carriers with function group, N-terminal methionine are provided in SEQ ID NO: 131-SEQ ID NO: 135. Such carrier (e.g., $Cholix^{206}$, $Cholix^{245}$, $Cholix^{251}$, $Cholix^{266}$, and $Cholix^{386}$) can be used for rapid (e.g., at least $10^{-6}$ cm/sec, $10^{-5}$ cm/sec) and efficient (e.g., at least 5%, 10%, 20%, 25%, or 50% of material applied to the apical surface) transport of a payload across an epithelial cell (see, e.g., EXAMPLE 5).

It is postulated that the sequence of amino acid residues 188-206 (e.g., "AQKEGSRHKRWAHWHTGLA," SEQ ID NO: 168) with its one or more histidine residues can act as a pH-switch, thereby allowing the carrier to interact with TRIPs such as TMEM132, LMAN1, GRP75, and perlecan in a sequential and/or pH-dependent manner.

TABLE 7 below shows additional Cholix derived polypeptide sequences described herein.

TABLE 7

Additional Examples of Cholix derived Polypeptide Sequences

| SEQ ID NO | Sequence |
|---|---|
| SEQ ID NO: 140 | MVEEALNIFDECRSPCSLTPEPGKPIQSKLSIPSDVVLDEGV LYYSMTINDEQNDIKDEDKGESIITIGEFATVRATRHYVNQD APFGVIHLDITTENGTKTYSYNRKEGEFAINWLVPIGEDSPA SIKISVDEL |
| SEQ ID NO: 179 | VEDELNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIHFSKGNAMSALAAHRVCGVPLETLARSRKPRDL TDDLSCAYQAQNIVSLFVATRILFSHLDSVFTLNLDEQEPEV AERLSDLRRINE |
| SEQ ID NO: 189 | VEEALNIFDECRSPCSLTPEPGKPIQSKLSIPSDVVLDEGVL YYSMTINDEQNDIKDEDKGESIITIGEFATVRATRHYVNQDA PFGVIHLDITTENGTKTYSYNRKEGEFAINWLVPIGEDSPAS IKISVDELDQQRNIIEVPKLYSIDLDNQTLEQWKTQGNVSFS VTRPEHNIAISWPSVSYKAAQKEGSRHKRWAHWHTGLALCWL VPMDAIYNYITQQNCTLGDNWFGGSYETVAGTPKVITVKQGI EQKPVEQRIAQNIVSLFVATRILFSHLDSVFTLNLDEQEPEV AERLSDLRRINENNPGMVTQVLTVARQIYNDYVTHHPGLTPE QTSAGAQAADILSLFCPDADKSCVASNNDQANINIESRSGRS YLPENRAVITPQGVTNWTYQELEATHQALTREGYVFVGYHGT NHVAAQTIVNRIAPVPRGNNTENEEKWGGLYVATHAEVAHGY ARIKEGTGEYGLPTRAERDARGVMLRVYIPRASLERFYRTNT PLENAEEHITQVIGHSLPLRNEAFTGPESAGGEDTVIGWDMA IHAVAIPSTIPGNAYEELAIDEEAVAKEQSISTKPPYKERKD ELK |

III. Heterologous Payload

Heterologous payloads contemplated herein can be of any nature, including therapeutic, diagnostic, and imaging. A payload can be part of a delivery construct. A delivery construct can include a carrier coupled to a heterologous payload. The payload can be directly or indirectly, covalently or non-covalently, coupled to the carrier. When covalently attached, a payload can be directly attached to a carrier or via a spacer.

The heterologous payload can be a small molecule, a nucleic acid, a polypeptide, a protein, a nanoparticle, or a combination thereof.

Therapeutic Payloads

In some instances, the therapeutic payload is a polypeptide such as, e.g., a cytokine, a hormone, a growth factor, a therapeutic antibody, a nucleic acid, an antigen, an enzyme, clotting factor, neurotransmitter, or a polymer.

Cytokines provided herein include chemokines and interleukins (also abbreviated herein as "ILs"). The interleukin can be an IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IL-34, IL-35, IL-36, IL-37, IL-38, IL-39, or IL-40.

In some instances, the interleukin is an IL-10 or an IL-22. The interleukin can be from any species (e.g., from a human or a rodent), and is preferably from the organism to which it is intended to administer the payload or delivery construct comprising such payload. Thus, in some instances, the interleukin is a human interleukin. An interleukin provided herein can be a precursor to a mature, secreted interleukin. Such a precursor interleukin can comprise a signal peptide sequence. For example, in some instances, a therapeutic payload can be a precursor of a mature, secreted protein. In other instances, the therapeutic payload is the secreted protein. For example, in some instances, the payload comprises, consists essentially of, or consists of SEQ ID NO 141, which is a full length, precursor of IL-22. In other instances, the payload comprises, consists essentially of, or consists of SEQ ID NO: 142, which is a secreted form of IL-22. In another example, the payload comprises, consists essentially of, or consists of SEQ ID NO 144, which is a full length, precursor of IL-10. In other instances, the payload comprises, consists essentially of, or consists of SEQ ID NO: 145, which is a secreted form of IL-10.

A heterologous payload can comprise an N-terminal methionine. For example, an IL-22 payload can comprise an N-terminal methionine. In such instances, the IL-22 can have a sequence of SEQ ID NO: 143.

In some embodiments, the therapeutic payload is an IL-22. The IL-22 can comprise, consist essentially of, or consist of an amino acid sequence having at least 80%, 85%, 90%, 95%, 98% or 99%% sequence identity to the amino acid sequence set forth in SEQ ID NO: 141 or SEQ ID NO: 142, or a functional fragment thereof. In some embodiments, the therapeutic payload comprises, consists essentially of, or consists of the amino acid sequence set forth in SEQ ID NO: 142.

In some embodiments, the therapeutic payload is an IL-10. The IL-10 can comprise, consist essentially of, or consist of an amino acid sequence having at least 80%, 85%, 90%, 95%, 98% or 99%% sequence identity to the amino acid sequence set forth in SEQ ID NO: 144 or SEQ ID NO: 145, or a functional fragment thereof. In some embodiments, the therapeutic payload comprises, consists essentially of, or consists of the amino acid sequence set forth in SEQ ID NO: 145.

Hormones provided herein can include peptide and polypeptide hormones. Such hormones can include growth hormones, e.g., human growth hormone (also referred to herein as hGH or somatotropin); pituitary hormones, e.g., chorionic gonadotropin, cosyntropin, menotropins, iorticotropin, protirelin, thyrotropin, vasopressin, lypressin; parathyroid hormones; thyroid hormones; testicular hormones; gastrointestinal hormones, e.g., gastric inhibitory polypeptide, epidermal growth factor-urogastrone, gastric inhibitory polypeptide, gastrin-releasing peptide, gastrins, pentagastrin, tetragastrin, motilin, neuropeptide Y, peptide YY, secretin, vasoactive intestinal peptide, sincalide; incretin hormones, e.g., glucagon-like peptide-1 (GLP-1) and glucose-dependent insulinotropic polypeptide (GIP); metabolic hormones, e.g., insulin; and any derivatives or fragments thereof.

In some embodiments, the hormone is a human growth hormone comprising, consisting essentially of, or consisting of an amino acid sequence having at least 80%, 85%, 90%, 95%, 98%, or 99% sequence identity to the amino acid sequence set forth in SEQ ID NOs: 146 or 190, or a fragment thereof.

In some embodiments, the therapeutic payload is glucose-lowering agent. In such instances, the payload can be a GLP-1 agent or a GLP-1 agonist. Such agonist can Exenatide or Liraglutide. In other instances, the glucose-lowering agent can be an incretin, a glucagon proprotein, a glucagon-like peptide (e.g., other than GLP-1), a glicentin-related polypeptide, an exendin-3, an exendin-4, lixisenatide (tradenames Adlyxin®, and Lyxumia®, Sanofi), liraglutide (tradename Victoza®, Novo Nordisk A/S), semaglutide (tradename Ozempic®, Novo Nordisk A/S), albiglutide (tradename Tanzeum®, GlaxoSmithKline; GLP-1 dimer fused to albumin), dulaglutide (tradename Trulicity®, Eli Lilly), a glucose-dependent insulinotropic polypeptide, Tirzepatide (Eli Lilly), Dual Amylin Calcitonin Receptor Agonist DACRA-089, Glargine/Lantus®, Glulisin/Apidra®, Glarine/Toujeo®, Insuman®, Detemir/Levemir®, Lispro/Humalog®/Liprolog®, Humulin®, Linjeta, SuliXen®, NN1045, Insulin plus Symlin™, PE0139, fast-acting and short-acting insulins (e.g. Linjeta, PH20, NN1218, HinsBet), (APC-002) hydrogel, oral, inhalable, transdermal and sublingual insulins (e.g. Exubera®, Nasulin®, Afrezza®, Tregopil®, TPM 02, Capsulin, Oral-lyn®, Cobalamin®, oral insulin, ORMD-0801, NN1953, NN1954, NN1956, VIAtab, and Oshadi oral insulin).

In some instances, the therapeutic payload is a therapeutic antibody or a binding fragment thereof. Therapeutic antibodies can include anti-TNFα antibodies. Such anti-TNFα antibodies can be humanized or human antibodies. Anti-TNFα agents can include infliximab (Remicade®), adalimumab (Humira®), or etanercept (ENBREL®).

In some instances, the payload is an antineoplastic agent. Antineoplastic agents can include nitrosoureas, e.g., carmustine, lomustine, semustine, strepzotocin; methylhydrazines, e.g., procarbazine, dacarbazine; steroid hormones, e.g., glucocorticoids, estrogens, progestins, androgens, tetrahydrodesoxycaricosterone; immunoactive compounds such as immunosuppressives, e.g., pyrimethamine, trimethopterin, penicillamine, cyclosporine, azathioprine; and immunostimulants, e.g., levamisole, diethyl dithiocarbamate, enkephalins, endorphins; antimicrobial compounds such as antibiotics, e.g., beta-lactam, penicillin, cephalosporins, carbapenims and monobactams, beta-lactamase inhibitors, aminoglycosides, macrolides, tetracyclins, spectinomycin; antimalarials, amebicides; antiprotazoals; antifungals, e.g., amphotericin-beta, antivirals, e.g., acyclovir, idoxuridine, ribavirin, trifluridine, vidarbine, gancyclovir; parasiticides; antihalmintics; radiopharmaceutics; gastrointestinal drugs; hematologic compounds; immunoglobulins; blood clotting proteins, e.g., anti-hemophilic factor, factor IX complex; anticoagulants, e.g., dicumarol, heparin Na; fibrolysin inhibitors, e.g., tranexamic acid; cardiovascular drugs; peripheral anti-adrenergic drugs; centrally acting antihypertensive drugs, e.g., methyldopa, methyldopa HCl; antihypertensive direct vasodilators, e.g., diazoxide, hydralazine HCl; drugs affecting renin-angiotensin system; peripheral vasodilators, e.g., phentolamine; anti-anginal drugs; cardiac glycosides; inodilators, e.g., amrinone, milrinone, enoximone, fenoximone, imazodan, sulmazole; antidysrhythmics; calcium entry blockers; drugs affecting blood lipids, e.g., ranitidine, bosentan, rezulin; respiratory drugs; sypathomimetic drugs, e.g., albuterol, bitolterol mesylate, dobutamine HCl, dopamine HCl, ephedrine sodium (So), epinephrine, fenfluramine HCl, isoproterenol HCl, methoxamine HCl, norepinephrine bitartrate, phenylephrine HCl, ritodrine HCl; cholinomimetic drugs, e.g., acetylcholine HCl; anticholinesterases, e.g., edrophonium chloride (Cl); cholinesterase reactivators; adrenergic blocking drugs, e.g., acebutolol HCl, atenolol, esmolol HCl, labetalol HCl, metoprolol, nadolol, phentolamine mesylate, propanolol HCl; antimuscarinic drugs, e.g., anisotropine methylbromide, atropine, clinidium bromide (Br), glycopyrrolate, ipratropium Br, scopolamine HBr; neuromuscular blocking drugs; depolarizing drugs, e.g., atracurium besylate, hexafluorenium Br, metocurine iodide, succinylcholine Cl, tubocurarine Cl, vecuronium Br; centrally acting muscle relaxants, e.g., baclofen; neurotransmitters and neurotransmitter agents, e.g., acetylcholine, adenosine, adenosine triphosphate; amino acid neurotransmitters, e.g., excitatory amino acids, GABA, glycine; biogenic amine neurotransmitters, e.g., dopamine, epinephrine, histamine, norepinephrine, octopamine, serotonin, tyramine; neuropeptides, nitric oxide; antiparkinson drugs, e.g., amaltidine HCl, benztropine mesylate, carbidopa; diuretic drugs, e.g., dichlorphenamide, methazolamide, bendroflumethiazide, polythiazide; antimigraine drugs, e.g., carboprost tromethamine mesylate, or methysergide maleate, or a functional derivative thereof.

In some instances, the payload is an enzyme such as hyaluronidase, streptokinase, tissue plasminogen activator, urokinase, PGE-adenosine deaminase; intravenous anesthetics such as droperidol, etomidate, fetanyl citrate/droperidol, hexobarbital, ketamine HCl, methohexital Na, thiamylal Na, thiopental Na; antiepileptics, e.g., carbamazepine, clonazepam, divalproex Na, ethosuximide, mephenyloin, paramethadione, phenyloin, primidone. In various embodiments, the biologically active payload is an enzyme selected from hyaluronidase, streptokinase, tissue plasminogen activator, urokinase, or PGE-adenosine deaminase.

TABLE 8 shows amino acid sequences of exemplary therapeutic payloads provided herein.

TABLE 8

Amino Acid Sequences of Exemplary Therapeutic Payloads

| SEQ ID NO | Sequence |
|---|---|
| SEQ ID NO: 141 | MAALQKSVSSFLMGTLATSCLLLLALLVQGGAAAPIS SHCRLDKSNFQQPYITNRTFMLAKEASLADNNTDVRL IGEKLFHGVSMSERCYLMKQVLNFTLEEVLFPQSDRF QPYMQEVVPFLARLSNRLSTCHIEGDDLHIQRNVQKL KDTVKKLGESGEIKAIGELDLLFMSLRNACI |
| SEQ ID NO: 142 | APISSHCRLDKSNFQQPYITNRTFMLAKEASLADNNT DVRLIGEKLFHGVSMSERCYLMKQVLNFTLEEVLFPQ SDRFQPYMQEVVPFLARLSNRLSTCHIEGDDLHIQRN VQKLKDTVKKLGESGEIKAIGELDLLFMSLRNACI |
| SEQ ID NO: 143 | MAPISSHCRLDKSNFQQPYITNRTFMLAKEASLADNN TDVRLIGEKLFHGVSMSERCYLMKQVLNFTLEEVLFP QSDRFQPYMQEVVPFLARLSNRLSTCHIEGDDLHIQR NVQKLKDTVKKLGESGEIKAIGELDLLFMSLRNACI |
| SEQ ID NO: 144 | MHSSALLCCLVLLTGVRASPGQGTQSENSCTHFPGNL PNMLRDLRDAFSRVKTFFQMKDQLDNLLLKESLLEDF KGYLGCQALSEMIQFYLEEVMPQAENQDPDIKAHVNS LGENLKTLRLRLRRCHRFLPCENKSKAVEQVKNAFNK LQEKGIYKAMSEFDIFINYIEAYMTMKIRN |
| SEQ ID NO: 145 | SPGQGTQSENSCTHFPGNLPNMLRDLRDAFSRVKTFF QMKDQLDNLLLKESLLEDFKGYLGCQALSEMIQFYLE EVMPQAENQDPDIKAHVNSLGENLKTLRLRLRRCHRF LPCENKSKAVEQVKNAFNKLQEKGIYKAMSEFDIFIN YIEAYMTMKIRN |
| SEQ ID NO: 146 | FPTIPLSRLFDNAMLRAHRLHQLAFDTYQEFEEAYIP KEQKYSFLQNPQTSLCFSESIPTPSNREETQQKSNLE LLRISLLLIQSWLEPVQFLRSVFANSLVYGASDSNVY DLLKDLEEGIQTLMGRLEDGSPRTGQIFKQTYSKFDT NSHNDDALLKNYGLLYCFRKDMDKVETFLRIVQCRSV EGSCGF |
| SEQ ID NO: 190 | MFPTIPLSRLFDNAMLRAHRLHQLAFDTYQEFEEAYI PKEQKYSFLQNPQTSLCFSESIPTPSNREETQQKSNL ELLRISLLLIQSWLEPVQFLRSVFANSLVYGASDSNV YDLLKDLEEGIQTLMGRLEDGSPRTGQIFKQTYSKFD TNSHNDDALLKNYGLLYCFRKDMDKVETFLRIVQCRS VEGSCGF |
| SEQ ID NO: 195 | H-HisGlyGluGlyThrPheThrSerAspLeuSer LysGlnMetGluGluGluAlaValArgLeuPheIle GluTrpLeuLysAsnGlyGlyProSerSerGlyAla ProProProSer-NH₂ |

IV. Spacer

A carrier can be coupled to a heterologous payload via a spacer. A spacer provided herein can provide steric flexibility, accurate folding, and/or proper biological activity and function of both the carrier and the payload.

A spacer can comprise one or more amino acid residues. In some instances, the spacer is an amino acid-based spacer. Such spacer can comprise, consist essentially of, or consist of at least about 5, 10, 15, 20, 25, 35, 50, 75, or 100 amino acid residues. In some instances, a spacer comprises, consists essentially of, or consists of at most about 30, 25, 20, 15, or 10 amino acid residues. In some instances, the majority (e.g., more than 90%) of these amino acid residues are glycine and/or serine residues.

A spacer can be a cleavable or non-cleavable spacer. In some instances, a cleavable spacer can be cleaved by an enzyme, e.g., a protease. A non-cleavable spacer may not be cleavable by such enzyme. For example, a non-cleavable spacer can be used in cases where higher systemic concentrations of a payload are an objective.

A spacer can comprise one or more repeats of glycine-serine oligopeptide sequences. Thus, in some instances, a carrier comprises, consists essentially of, or consists of the amino acid sequences $(GS)_x$ (SEQ ID NO: 169), $(GGS)_x$ (SEQ ID NO: 170), $(GGGS)_x$ (SEQ ID NO: 171), $(GGGGS)_x$ (SEQ ID NO: 172), or $(GGGGGS)_x$ (SEQ ID NO: 173), wherein x=1, 2, 3, 4, 5, 6, 7, 8, 9, 10, 11, 12, 13, 14, or 15. In some cases, a spacer comprises, consists essentially of, or consists of the amino acid sequence $(GGGGS)_x$ (SEQ ID NO: 174), wherein x=1, 2, 3, 4 or 5. In such instances, a spacer can consist of 5, 10, 15, 20, or 25 amino acids.

Examples of spacers provided herein are those comprising, consisting essentially of, or consisting of an amino acid sequence having at least 50%, 75%, 90%, or 99% sequence identity to GGGGSGGGGSGGGGS (SEQ ID NO: 175), GGGGSGGGGSGGGG (SEQ ID NO: 176), or GGGG-SNLQGGLRQPR (SEQ ID NO: 177), a fragment of any of the above, or a combination of any of the above. In some instances, the spacer consists of the amino acid sequence set forth in any one or SEQ ID NO: 196 (GGGGS) or SEQ ID NO: 197 (GGGGSGGGGSGGGGSGGGGSGGGGS). In some instances, any of the above spacer can comprise an additional glycine or serine residue at either the N- and/or C-terminal.

In some embodiments, the spacer coupling a carrier to a therapeutic payload comprises an amino acid sequence having at least 50%, 75%, 90%, or 99% sequence identity to SEQ ID NOs: 175-176.

V. Delivery Constructs

Provided herein are delivery constructs (e.g., a carrier-payload complex) that can comprise a carrier coupled to a heterologous payload. A carrier can be coupled to such payload covalently or non-covalently (e.g., via ionic interactions, van der Waals interactions, π-π interactions, etc.). A carrier can be coupled directly or indirectly to a heterologous payload.

A heterologous payload can be coupled to an N- and/or C-terminus of a carrier. In some instances, a heterologous payload is directly and covalently coupled to a C-terminus of a carrier by forming a covalent amide bond between the C-terminal carboxyl group of the carrier and the N-terminal amine of the heterologous payload. In some instances, a heterologous payload is indirectly and covalently coupled to the carrier via a spacer.

Thus, in some instances, when a carrier is covalently coupled to a payload, the delivery construct can be represented according to Formula II: C—S—P or Formula III: P—S—C, wherein C is a carrier, S is a spacer, or optionally a bond, and P is a heterologous payload. A delivery construct can further comprise one or more modifications on its N-terminus and/or C-terminus. Such a modification(s) can include an N-terminal methionine residue. Thus, Formula II and Formula III can also include an N-terminal methionine (e.g., M+C—S—P) or (e.g., M+P—S—C).

A carrier can be coupled to a heterologous payload via chemical/synthetic conjugation (e.g., using amide coupling reactions) or by recombinant expression in a bacterial (e.g., in E. coli) or mammalian (e.g., Chinese Hamster Ovary (CHO)) cell as a fusion protein.

A delivery construct, or part thereof (e.g., the carrier and/or spacer), can be a polypeptide. The term "polypeptide," as used herein, can include both natural and unnatural amino acids.

Delivery constructs provided herein can transcytose across polarized epithelial cells with a high flux rate through one or more moderate-affinity, high-capacity dynamic and/or pH-dependent interactions of the carrier with one or more transport receptor-like interaction partners (TRIPs). Such TRIPs can be elements of an endogenous trafficking pathways, and as such, can allow a carrier to transport heterologous payload across the epithelial cell barrier without impairing the barrier itself and without significantly altering (e.g., chemically/enzymatically modifying) the carrier or the payload.

Furthermore, interactions with TRIPs can allow a carrier to transport a payload across an intact epithelium (e.g., a polarized gut epithelium) with transport rates of at least about $10^{-6}$ cm/sec, $10^{-5}$ cm/sec, or $10^{-4}$ cm/sec.

In some instances, a carrier is indirectly and non-covalently coupled to a payload. In such instances, nanoparticles (e.g., liposomes, metallic nanoparticles, polymer-based nanoparticles, etc.) can be loaded (e.g., on the inside and/or on the surface of the particle) with payload molecules (e.g., IL-10, IL-22, GLP-1, etc.), and Cholix derived carrier molecule(s) can be coupled to such nanoparticles (e.g., onto its surface). In some instances, a ratio of payload to carrier can be at least about 15000:1, 10000:1, 5000:1, 2500:1, 1000:1, 500:1, 250:1, 100:1, 50:1, 25:1, 10:1, 5:1, 2.5:1, 1:1. This can allow transport of such payload-containing nanoparticles into or across polarized epithelial cells (e.g., polarized gut epithelial cells) using the Cholix derived carriers attached to the surface. In some cases, a nanoparticle can release the payload following transcytosis or intracellular delivery. In cases where the nanoparticle is transported across epithelial cells, the released payload can bind to receptors within submucosal tissue (e.g., lamina propria) and/or can enter the systemic circulation and thus provide a certain function (e.g., a therapeutic or diagnostic function) systemically. In other cases, where a nanoparticle releases the payload inside an epithelial cell, the payload (e.g., a nucleic acid) may provide certain intracellular functions, e.g., production of transgenes within these cells, modulation of gene expression, etc.

Exemplary Delivery Constructs

In various embodiments, a delivery construct or carrier-payload complex comprises (a) a carrier comprising a Cholix polypeptide that does not comprise SEQ ID NO: 179, and does not consist of SEQ ID NO: 126, complexed with (b) a heterologous payload, wherein the carrier is capable of (i) transcytosing the heterologous payload across a polarized epithelial cell; or (ii) transporting the heterologous payload into the polarized epithelial cell.

In some embodiments, a delivery construct comprises a Cholix derived carrier comprising, consisting essentially of, or consisting of at least 80%, 85%, 90%, 95%, 98%, or 99% sequence identity to the amino acid residues 1-386 of the amino acid sequence set forth in SEQ ID NO: 1 or 2.

In some embodiments, a delivery construct comprises a Cholix derived carrier comprising, consisting essentially of, or consisting of at least 80%, 85%, 90%, 95%, 98%, or 99% sequence identity to the amino acid residues from any one of the positions 1-40 to any one of the amino acid residues at positions 150-347 of the amino acid sequence set forth in SEQ ID NO: 1. In some instances, such carrier comprises, consists essentially of, or consists of at least 80%, 85%, 90%, 95%, 98%, or 99% sequence identity to the amino acid residues from positions 1-151, 1-187, 41-187, 1-206, 1-245, 1-251, or 1-266 of the amino acid sequence set forth in SEQ ID NO: 1. In other instances, a carrier comprises, consists essentially of, or consists of at least 80%, 85%, 90%, 95%, 98%, or 99% sequence identity to the amino acid residues from positions 1-151, 1-187, 41-187, 1-206, 1-245, 1-251, or 1-266 of the amino acid sequence set forth in SEQ ID NO: 2.

Any of such carriers can be coupled to a therapeutic payload comprising, consisting essentially of, or consisting of at least 80%, 85%, 90%, 95%, 98%, or 99% sequence identity to the amino acid sequences set forth in SEQ ID NOs: 141, 142, 144, 145, and 146.

Such therapeutic payload can be coupled to a Cholix derived carrier via a spacer comprising, consisting essentially of, or consisting of at least 66%, 73%, 80%, 86%, 93%, or 100% sequence identity to the amino acid sequence GGGGSGGGGSGGGGS (SEQ ID NO: 175).

Thus, in some instances, a delivery construct comprises a carrier comprising, consisting essentially of, or consisting of an amino acid sequence having at least 80%, 85%, 90%, 95%, 98% or 99% sequence identity to SEQ ID NO: 134 coupled via a spacer to a therapeutic payload comprising, consisting essentially of, or consisting of an amino acid sequence having at least 80%, 85%, 90%, 95%, 98% or 99% sequence identity to SEQ ID NO: 142. In some instances, the spacer comprises, consists essentially of, or consists of an amino acid sequence having at least 66%, 73%, 80%, 86%, 93%, or 100% sequence identity to SEQ ID NO: 175.

In other instances, a delivery construct comprises a carrier comprising, consisting essentially of, or consisting of an amino acid sequence having at least 80%, 85%, 90%, 95%, 98% or 99% sequence identity to SEQ ID NO: 135 coupled via a spacer to a therapeutic payload comprising, consisting essentially of, or consisting of an amino acid sequence having at least 80%, 85%, 90%, 95%, 98% or 99% sequence identity to SEQ ID NO: 142. In some instances, the spacer comprises, consists essentially of, or consists of an amino acid sequence having at least 66%, 73%, 80%, 86%, 93%, or 100% sequence identity to SEQ ID NO: 175.

In some instances, a delivery construct comprises a carrier comprising, consisting essentially of, or consisting of an amino acid sequence having at least 80%, 85%, 90%, 95%, 98% or 99% sequence identity to SEQ ID NO: 134 via a spacer comprising, consisting essentially of, or consisting of an amino acid sequence having at least 66%, 73%, 80%, 86%, 93%, or 100% sequence identity to SEQ ID NO: 175 to a therapeutic payload. Such therapeutic payload can be a cytokine, a hormone, or a therapeutic antibody or a functional binding fragment thereof. In some instances, the therapeutic payload comprises, consists essentially of, or consists of an amino acid sequence having at least 80%, 85%, 90%, 95%, 98%, or 99% sequence identity to SEQ ID NO: 142, SEQ ID NO: 145, or SEQ ID NO: 146.

In some instances, a delivery construct comprises a carrier comprising, consisting essentially of, or consisting of an amino acid sequence having at least 80%, 85%, 90%, 95%, 98% or 99% sequence identity to SEQ ID NO: 135 via a spacer comprising, consisting essentially of, or consisting of an amino acid sequence having at least 66%, 73%, 80%, 86%, 93%, or 100% sequence identity to SEQ ID NO: 176 to a therapeutic payload. Such therapeutic payload can be a cytokine, a hormone, or a therapeutic antibody or a functional binding fragment thereof. In some instances, the therapeutic payload comprises, consists essentially of, or consists of an amino acid sequence having at least 80%, 85%, 90%, 95%, 98%, or 99% sequence identity to SEQ ID NO: 145.

In some instances, a delivery construct comprises, consists essentially of, or consists of at least 80%, 85%, 90%, 95%, 98% or 99% sequence identity to the amino acid sequence set forth in any one of SEQ ID NOs: 147-150, 152-159, or 188.

In some embodiments, a delivery construct consists of the amino acid sequence set forth in SEQ ID NO: 147.

In some embodiments, a delivery construct consists of the amino acid sequence set forth in SEQ ID NO: 149.

In some embodiments, a delivery construct consists of the amino acid sequence set forth in SEQ ID NO: 188.

Amino acid sequences of exemplary delivery constructs herein are shown in TABLE 9.

TABLE 9

Amino Acid Sequences of Exemplary Delivery Constructs

| SEQ ID NO | Sequence |
| --- | --- |
| SEQ ID NO: 147 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GGGGGSGGGGSGGGGSAPISSHCRLDKSNFQQPYITNR TFMLAKEASLADNNTDVRLIGEKLFHGVSMSERCYLMK QVLNFTLEEVLFPQSDRFQPYMQEVVPFLARLSNRLST CHIEGDDLHIQRNVQKLKDTVKKLGESGEIKAIGELDL LFMSLRNACI |
| SEQ ID NO: 148 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GNAMSALAAHRVCGVPLETLARSRKPRDLTDDLSCAYQ AQNIVSLFVATRILFSHLDSVFTLNLDEQEPEVAERLS DLRRINENNPGMVTQVLTVARQIYNDYVTHHPGLTPEQ TSAGAQAGGGGSGGGGSGGGGSAPISSHCRLDKSNFQQ PYITNRTFMLAKEASLADNNTDVRLIGEKLFHGVSMSE RCYLMKQVLNFTLEEVLFPQSDRFQPYMQEVVPFLARL SNRLSTCHIEGDDLHIQRNVQKLKDTVKKLGESGEIKA IGELDLLFMSLRNACI |
| SEQ ID NO: 149 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GNAMSALAAHRVCGVPLETLARSRKPRDLTDDLSCAYQ AQNIVSLFVATRILFSHLDSVFTLNLDEQEPEVAERLS DLRRINENNPGMVTQVLTVARQIYNDYVTHHPGLTPEQ TSAGAQAGGGGSGGGGSGGGGSPGQGTQSENSCTHFPG NLPNMLRDLRDAFSRVKTFFQMKDQLDNLLLKESLLED FKGYLGCQALSEMIQFYLEEVMPQAENQDPDIKAHVNS LGENLKTLRLRLRRCHRFLPCENKSKAVEQVKNAFNKL QEKGIYKAMSEFDIFINYIEAYMTMKIRN |
| SEQ ID NO: 150 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GGGGGSNLQGGLRQPRFPTIPLSRLFDNAMLRAHRLHQ LAFDTYQEFEEAYIPKEQKYSFLQNPQTSLCFSESIPT PSNREETQQKSNLELLRISLLLIQSWLEPVQFLRSVFA NSLVYGASDSNVYDLLKDLEEGIQTLMGRLEDGSPRTG QIFKQTYSKFDTNSHNDDALLKNYGLLYCFRKDMDKVE TFLRIVQCRSVEGSCGF |
| SEQ ID NO: 151 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELGGGGSGGGGSGGGGSFP TIPLSRLFDNAMLRAHRLHQLAFDTYQEFEEAYIPKEQ KYSFLQNPQTSLCFSESIPTPSNREETQQKSNLELLRI SLLLIQSWLEPVQFLRSVFANSLVYGASDSNVYDLLKD LEEGIQTLMGRLEDGSPRTGQIFKQTYSKFDTNSHNDD ALLKNYGLLYCFRKDMDKVETFLRIVQCRSVEGSCGF |
| SEQ ID NO: 152 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL GGGGSGGGGSGGGGSFPTIPLSRLFDNAMLRAHRLHQL AFDTYQEFEEAYIPKEQKYSFLQNPQTSLCFSESIPTP SNREETQQKSNLELLRISLLLIQSWLEPVQFLRSVFAN SLVYGASDSNVYDLLKDLEEGIQTLMGRLEDGSPRTGQ IFKQTYSKFDTNSHNDDALLKNYGLLYCFRKDMDKVET FLRIVQCRSVEGSCGF |
| SEQ ID NO: 153 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAGG GGSGGGGSGGGGSFPTIPLSRLFDNAMLRAHRLHQLAF DTYQEFEEAYIPKEQKYSFLQNPQTSLCFSESIPTPSN REETQQKSNLELLRISLLLIQSWLEPVQFLRSVFANSL VYGASDSNVYDLLKDLEEGIQTLMGRLEDGSPRTGQIF KQTYSKFDTNSHNDDALLKNYGLLYCFRKDMDKVETFL RIVQCRSVEGSCGF |
| SEQ ID NO: 154 | MVLYYSMTINDEQNDIKDEDKGESIITIGEFATVRATR HYVNQDAPFGVIHLDITTENGTKTYSYNRKEGEFAINW LVPIGEDSPASIKISVDELDQQRNIIEVPKLYSIDLDN QTLEQWKTQGNVSFSVTRPEHNIAISWPSVSYKAGGGG SGGGGSGGGGSFPTIPLSRLFDNAMLRAHRLHQLAFDT YQEFEEAYIPKEQKYSFLQNPQTSLCFSESIPTPSNRE ETQQKSNLELLRISLLLIQSWLEPVQFLRSVFANSLVY GASDSNVYDLLKDLEEGIQTLMGRLEDGSPRTGQIFKQ TYSKFDTNSHNDDALLKNYGLLYCFRKDMDKVETFLRI VQCRSVEGSCGF |
| SEQ ID NO: 155 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLAGGGGSGGGGSGGGGSFPTIPL SRLFDNAMLRAHRLHQLAFDTYQEFEEAYIPKEQKYSF LQNPQTSLCFSESIPTPSNREETQQKSNLELLRISLLL IQSWLEPVQFLRSVFANSLVYGASDSNVYDLLKDLEEG |

TABLE 9-continued

Amino Acid Sequences of Exemplary Delivery Constructs

| SEQ ID NO | Sequence |
|---|---|
| | IQTLMGRLEDGSPRTGQIFKQTYSKFDTNSHNDDALLK NYGLLYCFRKDMDKVETFLRIVQCRSVEGSCGF |
| SEQ ID NO: 156 | MGVLYYSMTINDEQNDIKDEDKGESIITIGEFATVRAT RHYVNQDAPFGVIHLDITTENGTKTYSYNRKEGEFAIN WLVPIGEDSPASIKISVDELDQQRNIIEVPKLYSIDLD NQTLEQWKTQGNVSFSVTRPEHNIAISWPSVSYKAAQK EGSRHKRWAHWHTGLGGGGSGGGGSGGGGSFPTIPLSR LFDNAMLRAHRLHQLAFDTYQEFEEAYIPKEQKYSFLQ NPQTSLCFSESIPTPSNREETQQKSNLELLRISLLLIQ SWLEPVQFLRSVFANSLVYGASDSNVYDLLKDLEEGIQ TLMGRLEDGSPRTGQIFKQTYSKFDTNSHNDDALLKNY GLLYCFRKDMDKVETFLRIVQCRSVEGSCGFHHHHHH |
| SEQ ID NO: 157 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVGGGGSGGGGSGGGGSFPTIP LSRLFDNAMLRAHRLHQLAFDTYQEFEEAYIPKEQKYS FLQNPQTSLCFSESIPTPSNREETQQKSNLELLRISLL LIQSWLEPVQFLRSVFANSLVYGASDSNVYDLLKDLEE GIQTLMGRLEDGSPRTGQIFKQTYSKFDTNSHNDDALL KNYGLLYCFRKDMDKVETFLRIVQCRSVEGSCGF |
| SEQ ID NO: 158 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGGGGSGGGGSGGGG SFPTIPLSRLFDNAMLRAHRLHQLAFDTYQEFEEAYIP KEQKYSFLQNPQTSLCFSESIPTPSNREETQQKSNLEL LRISLLLIQSWLEPVQFLRSVFANSLVYGASDSNVYDL LKDLEEGIQTLMGRLEDGSPRTGQIFKQTYSKFDTNSH NDDALLKNYGLLYCFRKDMDKVETFLRIVQCRSVEGSC GF |
| SEQ ID NO: 159 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GGGGGSGGGGSFPTIPLSRLFDNAMLRAHRLHQ LAFDTYQEFEEAYIPKEQKYSFLQNPQTSLCFSESIPT PSNREETQQKSNLELLRISLLLIQSWLEPVQFLRSVFA NSLVYGASDSNVYDLLKDLEEGIQTLMGRLEDGSPRTG QIFKQTYSKFDTNSHNDDALLKNYGLLYCFRKDMDKVE TFLRIVQCRSVEGSCGF |
| SEQ ID NO: 188 | MLEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GGGGGSGGGGSGGGGSAPISSHCRLDKSNFQQPYITNR TFMLAKEASLADNNTDVRLIGEKLFHGVSMSERCYLMK QVLNFTLEEVLFPQSDRFQPYMQEVVPFLARLSNRLST CHIEGDDLHIQRNVQKLKDTVKKLGESGEIKAIGELDL LFMSLRNACI |
| SEQ ID NO: 198 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GGGGGSAPISSHCRLDKSNFQQPYITNRTFMLAKEASL ADNNTDVRLIGEKLFHGVSMSERCYLMKQVLNFTLEEV LFPQSDRFQPYMQEVVPFLARLSNRLSTCHIEGDDLHI QRNVQKLKDTVKKLGESGEIKAIGELDLLFMSLRNACI |
| SEQ ID NO: 199 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GGGGGGSGGGGSGGGGSGGGGSGGGGSAPISSHCRLDKS NFQQPYITNRTFMLAKEASLADNNTDVRLIGEKLFHGV SMSERCYLMKQVLNFTLEEVLFPQSDRFQPYMQEVVPF LARLSNRLSTCHIEGDDLHIQRNVQKLKDTVKKLGESG EIKAIGELDLLFMSLRNACI |
| SEQ ID NO: 200 | MAPISSHCRLDKSNFQQPYITNRTFMLAKEASLADNNT DVRLIGEKLFHGVSMSERCYLMKQVLNFTLEEVLFPQS DRFQPYMQEVVPFLARLSNRLSTCHIEGDDLHIQRNVQ KLKDTVKKLGESGEIKAIGELDLLFMSLRNACIGGGGS VEEALNIFDECRSPCSLTPEPGKPIQSKLSIPSDVVLD EGVLYYSMTINDEQNDIKDEDKGESIITIGEFATVRAT RHYVNQDAPFGVIHLDITTENGTKTYSYNRKEGEFAIN WLVPIGEDSPASIKISVDELDQQRNIIEVPKLYSIDLD NQTLEQWKTQGNVSFSVTRPEHNIAISWPSVSYKAAQK EGSRHKRWAHWHTGLALCWLVPMDAIYNYITQQNCTLG DNWFGGSYETVAGTPKVITVKQGIEQKPVEQRIHFSKG |
| SEQ ID NO: 201 | MVEEALNIFDECRSPCSLTPEPGKPIQSKLSIPSDVVL DEGVLYYSMTINDEQNDIKDEDKGESIITIGEFATVRA TRHYVNQDAPFGVIHLDITTENGTKTYSYNRKEGEFAI NWLVPIGEDSPASIKISVDELDQQRNIIEVPKLYSIDL DNQTLEQWKTQGNVSFSVTRPEHNIAISWPSVSYKAAQ KEGSRHKRWAHWHTGLALCWLVPMDAIYNYITQQNCTL GDNWFGGSYETVAGTPKVITVKQGIEQKPVEQRIHFSK GNAMSALAAHRVCGVPLETLARSRKPRDLTDDLSCAYQ AQNIVSLFVATRILFSHLDSVFTLNLDEQEPEVAERLS DLRRINENNPGMVTQVLTVARQIYNDYVTHHPGLTPEQ TSAGAQAGGGGSAPISSHCRLDKSNFQQPYITNRTFML AKEASLADNNTDVRLIGEKLFHGVSMSERCYLMKQVLN FTLEEVLFPQSDRFQPYMQEVVPFLARLSNRLSTCHIE GDDLHIQRNVQKLKDTVKKLGESGEIKAIGELDLLFMS LRNACI |

VI. Methods of Use

Provided herein, in some embodiments, are delivery constructs comprising a carrier coupled to a heterologous payload. The carriers provided herein can be used to transport such payload (e.g., a therapeutic payload) to various locations inside an epithelial cell such as the apical side (e.g., an apical recycling system), the basal side, and/or supranuclear compartment(s). Delivery across a polarized gut epithelium can include delivery to submucosal compartments (e.g., lamina propria and/or other submucosal intestinal compartments) and/or systemic circulation (e.g., via the hepatic portal system).

A. Methods of Treatment

The high flux transport capacities of carriers provided herein across intact epithelial barriers (e.g., a polarized gut epithelium) can be used to deliver therapeutic and/or diagnostic payload molecules to a subject in need thereof (e.g., a human or a rodent). For example, delivery of therapeutic payload to submucosal compartments, e.g., the lamina propria, can allow for treatment and/or diagnosis of diseases or conditions located at and/or originated from such locations in the GI tract, whereas systemic delivery of payload can be used to provide therapeutically effective concentrations in various cell(s), tissue(s), or organ(s) within an organism.

Diseases that can be treated using a delivery construct of this disclosure can include inflammatory diseases, autoimmune diseases, cancer, metabolic diseases, neurodegenerative diseases and neurological diseases, viral disease or infections, and cardiovascular disease.

In some instances, the inflammatory disease can include inflammatory bowel disease, psoriasis, bacterial sepsis, Crohn's disease (e.g., fistulizing Crohn's disease), ulcerative colitis (e.g., moderate-to-severe ulcerative colitis or mild-to-moderate ulcerative colitis), collagenous colitis, lymphocytic colitis, ischaemic colitis, diversion colitis, Behcet's syndrome, indeterminate colitis, pancreatitis, liver inflammation (e.g., a hepatitis), pouchitis, proctitis, and epithelial cell injury.

In some instances, the autoimmune disease can include systemic lupus erythematosus (SLE), pemphigus vulgaris, myasthenia gravis, hemolytic anemia, thrombocytopenia purpura, Grave's disease, Sjogren's disease, dermatomyositis, Hashimoto's disease, polymyositis, multiple sclerosis, diabetes mellitus, rheumatoid arthritis, and scleroderma.

In some instances, the cancer can include non-Hodgkin's lymphomas (NHL), Hodgkin's lymphoma, chronic lymphocytic leukemia, hairy cell leukemia, acute lymphoblastic leukemia, multiple myeloma, carcinomas of the bladder, kidney, ovary, cervix, breast, lung, or nasopharynx cancer, malignant melanoma, rituximab resistant NHL, and leukemia.

In some instances, the metabolic disorder can include diabetes, diabetes as a consequence of obesity, hyperglycemia, dyslipidemia, hypertriglyceridemia, syndrome X, insulin resistance, impaired glucose tolerance (IGT), diabetic dyslipidemia, hyperlipidemia, fatty liver disease, nonalcoholic steatohepatitis, obesity, impaired glucose tolerance, raised fasting glucose, insulin resistance, urinary albumin secretion, central obesity, hypertension, elevated triglycerides, elevated LDL cholesterol and/or reduced HDL cholesterol, hyperglycemia, hyperinsulinemia, dyslipidemia, ketosis, hypertriglyceridemia, syndrome X, insulin resistance, impaired fasting glucose, impaired glucose tolerance (IGT), diabetic dyslipidemia, gluconeogenesis, excess glycogenolysis, diabetic ketoacidosis, hypertriglyceridemia, hypertension, diabetic nephropathy, renal insufficiency, renal failure, hyperphagia, muscle wasting, diabetic neuropathy, diabetic retinopathy, diabetic coma, arteriosclerosis, coronary heart disease, peripheral artery disease, and hyperlipidemia.

In some instances, the cardiovascular disease can include vascular disease, heart disease, and stroke.

Other diseases and conditions that can be treated using a delivery construct of this disclosure can include growth hormone deficiency (GHD), Turner syndrome (TS), Noonan syndrome, Prader-Willi syndrome, short stature homeobox-containing gene (SHOX) deficiency, chronic renal insufficiency, idiopathic short stature, short bowel syndrome, allergy, graft-vs-host disease, anemia, disorders of hematopoietic cells, and diseases of the endocrine system or reproductive systems.

Furthermore, a delivery construct can be administered as a pharmaceutical composition to a subject in need thereof. A delivery construct herein can be formulated into a pharmaceutical composition for increased therapeutic efficacy. For example, a delivery construct can be formulated such that it is being released at specific location(s) in or around the GI tract of a subject. In some instances, a delivery construct can be formulated to increase its biological activity for engaging immune cells in the various part in or around the GI tract, such as the ileum.

A delivery construct can be administered via various administration routes. In some cases, administration includes oral administration of the delivery construct. In some instances, a delivery construct is orally administered as a tablet or a capsule.

B. Experimental Methods

Methods are provided herein for transcytosis testing and evaluation of Cholix Carrier interacting proteins (e.g., TRIPs).

1. Transcytosis Testing

The transcytosis function of an isolated delivery constructs can be tested as a function of the delivery construct's ability to pass through an epithelial membrane (e.g., a polarized gut epithelium) via transcytosis. The delivery construct's transcytosis activity can be tested by any method known by one of skill in the art, without limitation. In various embodiments, transcytosis activity can be tested by assessing the ability of a delivery construct to enter a non-polarized cell to which it binds. In cases of a Cholix derived carrier, and without intending to be bound to any particular theory or mechanism of action, it is described herein that the transcytosis function that allows a delivery construct to pass through a polarized epithelial cell and the function to enter non-polarized cells resides in the same domain or region, i.e., amino acid residues 1-266 of SEQ ID NO: 1. Thus, the delivery construct's ability to enter the cell can be assessed, for example, by detecting the physical presence of the construct in the interior of the cell. For example, the delivery construct can be labeled with, for example, a fluorescent marker, and the delivery construct exposed to the cell. Then, the cells can be washed, removing any delivery construct that has not entered the cell, and the amount of label remaining in the cell(s) can be determined. Detecting the label within these cells, e.g., using microscopy, indicates that the delivery construct has entered the cell.

Figure 1:
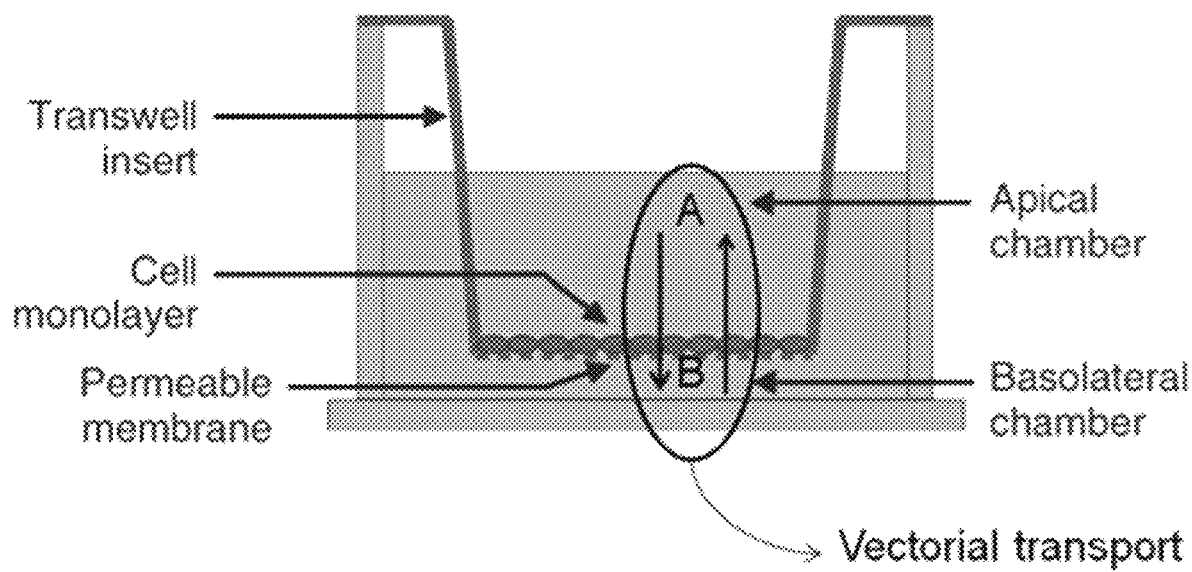
Figure 2:
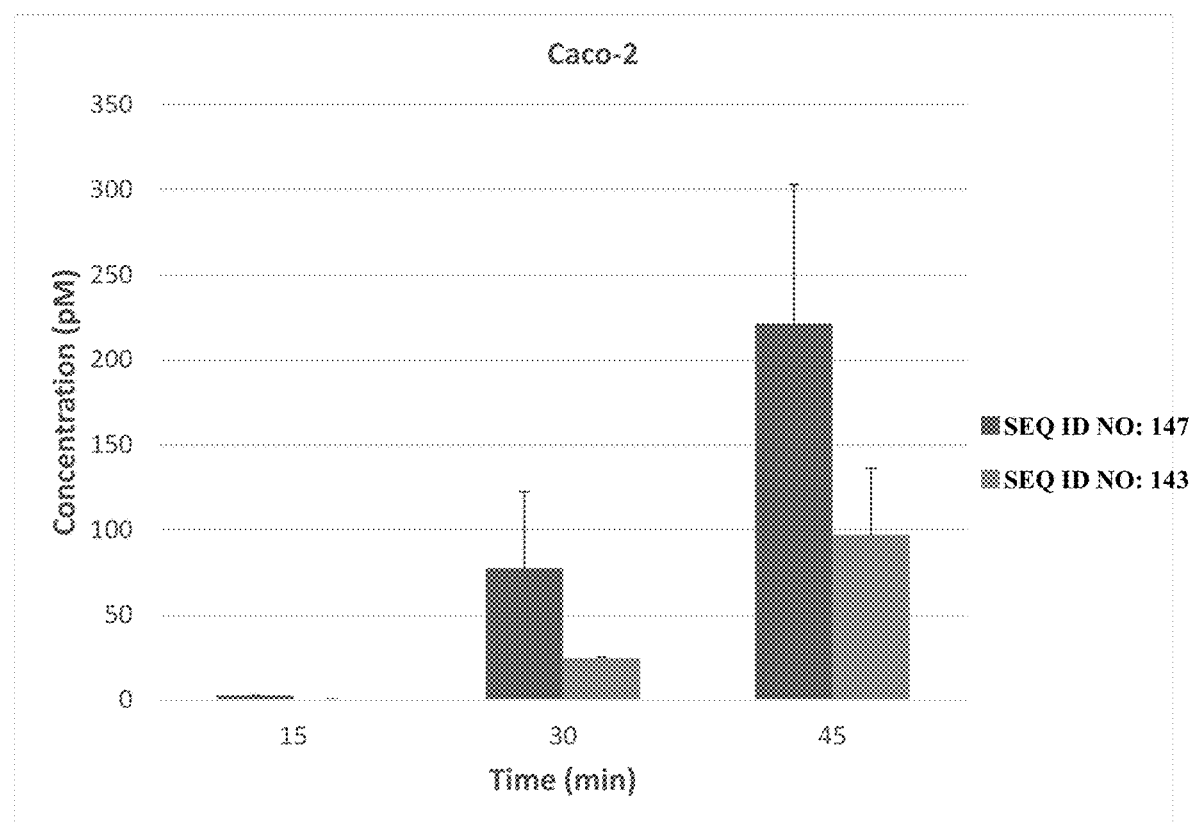
Figure 3:
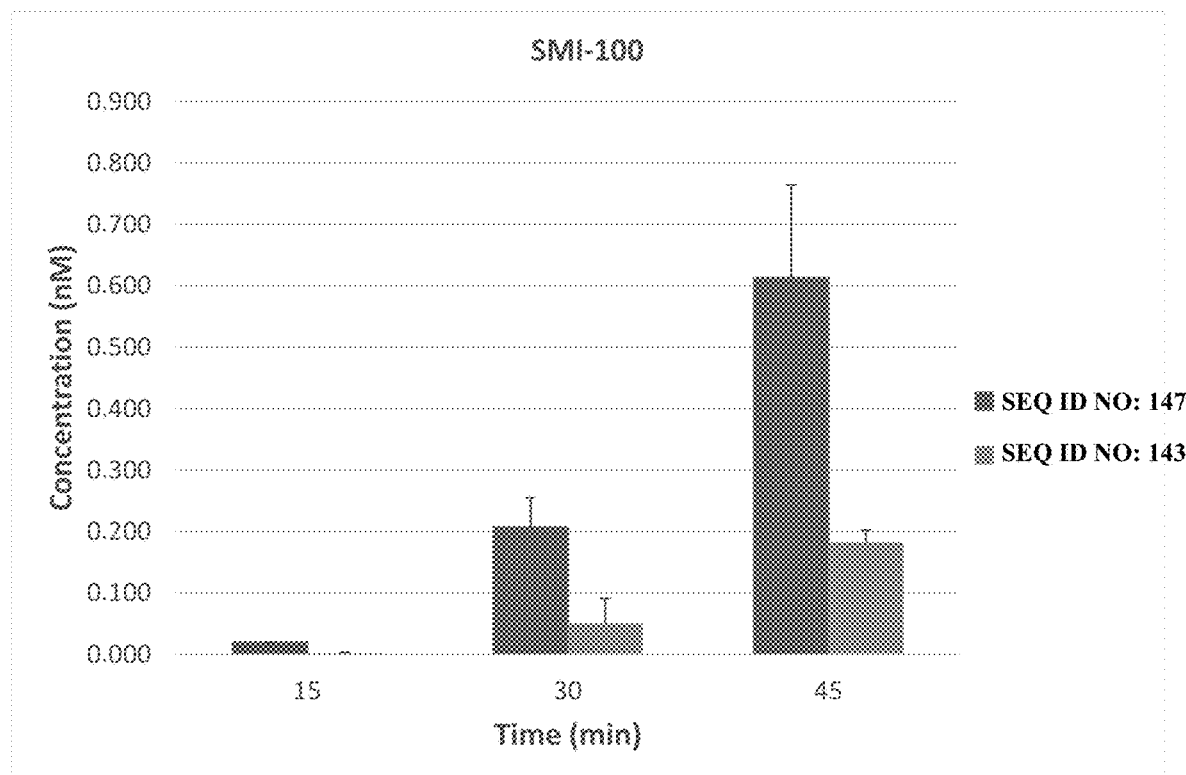
Figure 4:
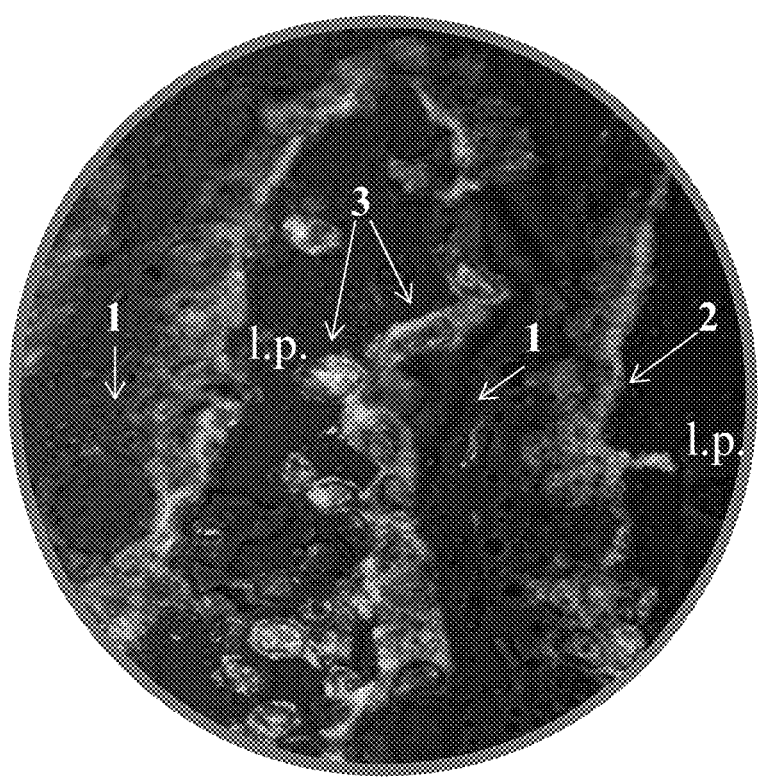
Figure 5:
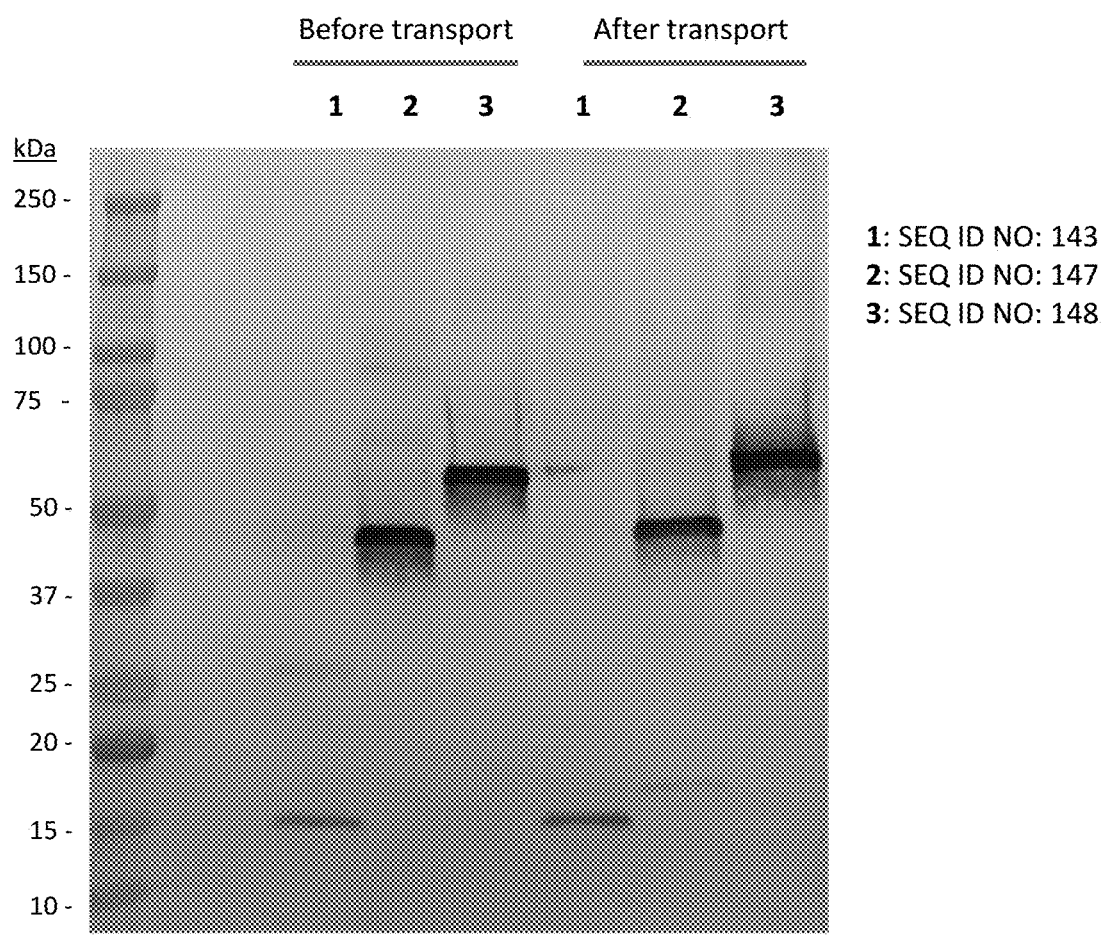
Figure 6:
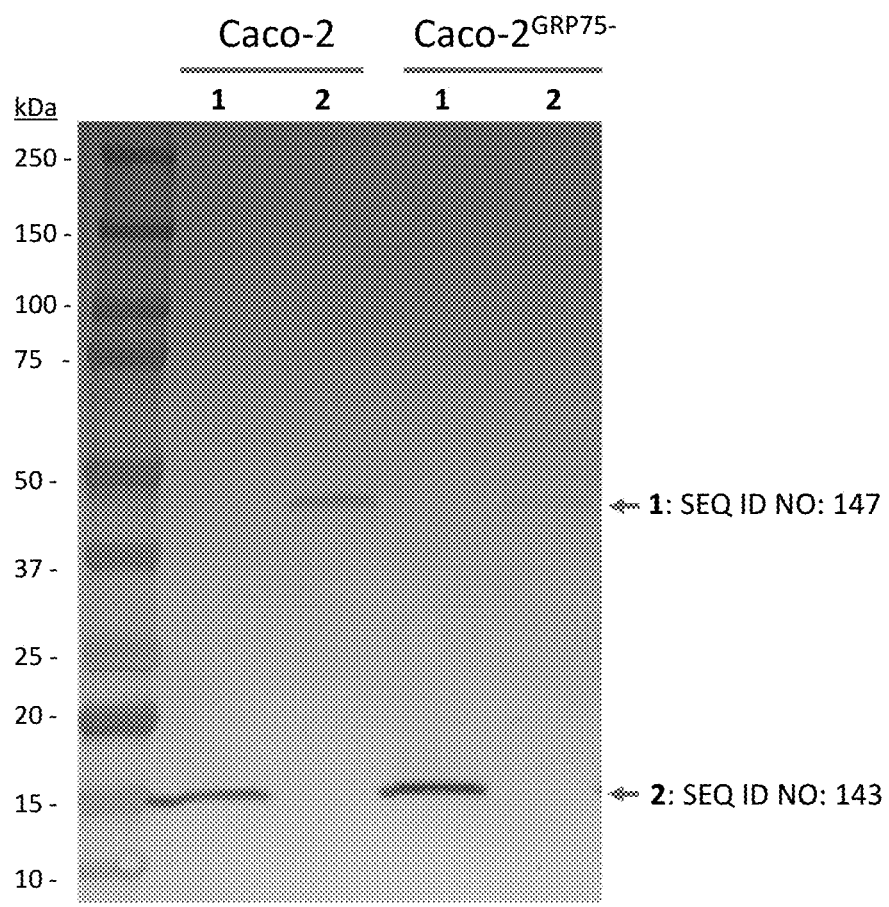
Figure 7:
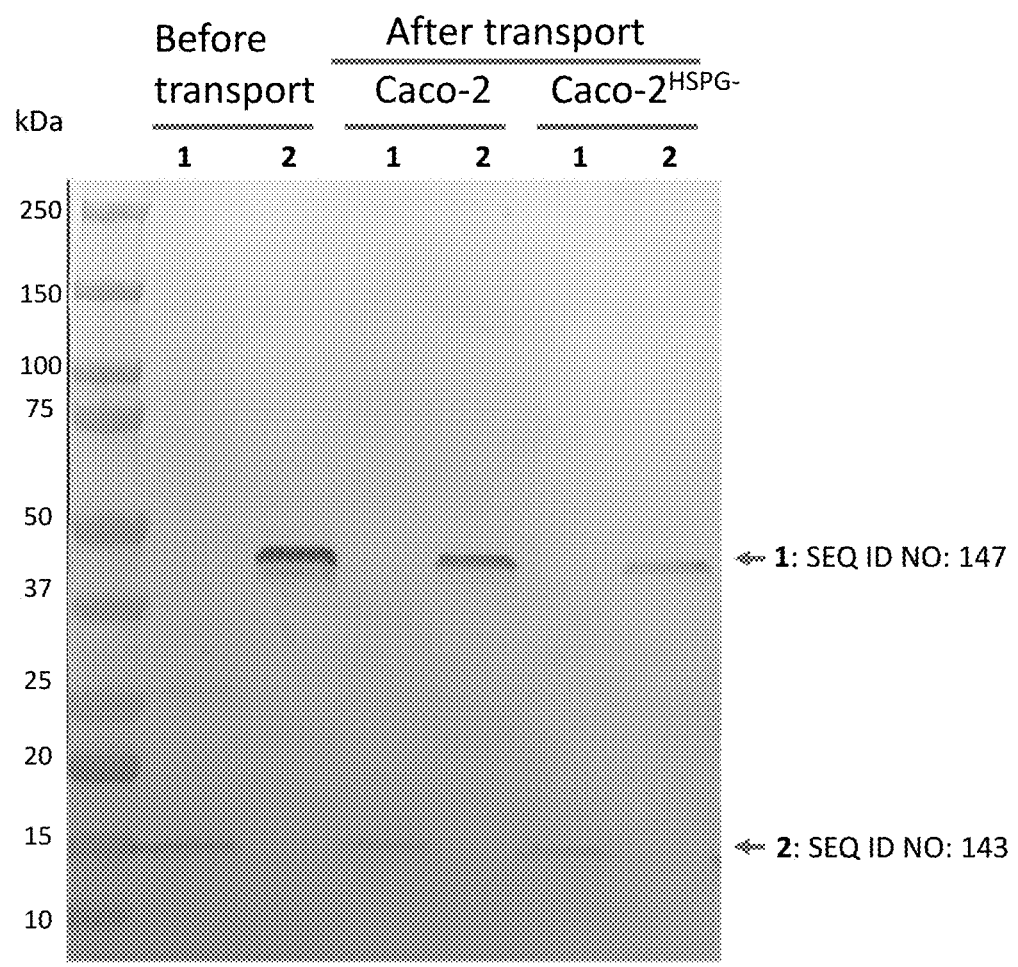

The delivery construct's transcytosis ability can be tested by assessing a delivery construct's ability to pass through a polarized epithelial cell. For example, the delivery construct can be labeled with, for example, a fluorescent marker (e.g., RFP) and contacted to the apical membranes of a layer of epithelial cells. In another example, the delivery construct can be detected using antibodies (e.g., monoclonal and/or polyclonal antibodies) directed against the delivery construct, or a portion thereof such as a Cholix derived carrier or a payload. Fluorescence detected on the basolateral side of the membrane formed by the epithelial cells (e.g., a basolateral chamber as illustrated in FIG. 1 or the lamina propria in in vivo experiments) indicates that the transcytosis capabilities of the carrier are intact.

In vivo transcytosis can be tested using male Wistar rats. Male Wistar rats can be housed 3-5 per cage with a 12/12 h light/dark cycle and can be 225-275 g (approximately 6-8 weeks old) when placed on study. Experiments can be conducted during the light phase using a non-recovery protocol that uses continuous isoflurane anesthesia. A 4-5 cm midline abdominal incision that exposes mid-jejunum regions can be conducted. Stock solutions at $3.86 \times 10^{-5}$ M of test articles can be prepared in phosphate buffered saline (PBS), with 50 µL (per 250 g rat) being administered by intraluminal injection (ILI) using a 29-gauge needle. The injection site mesentery can then be marked with a permanent marker. At study termination, a 3-5 mm region that captured the marked intestine segment can be isolated and processed for microscopic assessment. In vivo experiments can be performed in accordance with the U.K. Animals (Scientific Procedures) Act of 1986, the European Communities Council Directive of 1986 (86/609/EEC), and the University of Bath's ethical review procedures.

2. Evaluation of Cholix Carrier Interacting Proteins (i.e., TRIPs)

In order to identify Cholix interacting partners (e.g., receptors, enzymes, etc.) and establish the vesicular compartments where they interact with Cholix polypeptides (e.g., residues 1-266 of a Cholix sequence or a truncated version thereof), a series of pull-down assays can be performed to identify potential interaction partners that can be followed by in silico associations using surface plasmon resonance, in vitro transcytosis studies using polarized Caco-2 human intestinal epithelial cells where genetic knockdown of specific targets can be achieved, and in vivo transcytosis studies where Cholix elements and specific receptors can be co-localized in established vesicular structures. Without being bound to any theory, it is assumed that a transcytosis process can involve elements that are normally restricted within specific vesicular elements of polarized intestinal epithelial cells but can be recruited or "hijacked" by, e.g., Cholix derived carriers, to leave the late endosome and avoid lysosomal degradation following release from the cell into a basolateral compartment (e.g., via apical recycling mechanisms, apical receptor-mediated exocytosis, etc.).

3. Measuring Co-Localization of Carriers with Cellular Proteins

Co-localization of a carrier or carrier-payload complex described herein with one or more cellular proteins can be determined by fluorescence microscopy. For example, a Cholix derived carrier can be applied to the apical membrane of a polarized epithelial cell(s) (e.g., Caco-2) or to intestinal epithelial tissue. Following receptor-mediated endocytosis, the update of the carrier into the cell can be determined by fluorescence microscopy, e.g., by using labeled anti-Cholix carrier antibodies or dye-labeled carriers, or by using anti-payload antibodies. Samples or tissue sections can further be stained with markers specific for cellular proteins such as Rab7, Rab11, e.g., as described in EXAMPLE 7. Various image analysis techniques can then be used to determine the relative position of the carrier to the cellular protein (see e.g., EXAMPLE 6).

EXAMPLES

The following examples merely illustrate the disclosure and are not intended to limit the disclosure in any way.

Example 1

Production of Cholix-Derived Delivery Constructs

In this Example, the preparation of a delivery construct as a single amino acid sequence comprising a Cholix carrier sequence, a spacer sequence, and a therapeutic payload is described.

First, the gene of the delivery construct was amplified by PCR, incorporating restriction enzymes pairs of NdeI and EcoRI, PstI and PstI, AgeI and EcoRI, or PstI and EcoRI sites at two ends of the PCR products. After restriction enzyme digestion, the PCR products were cloned into an appropriate plasmid for cellular expression, which was digested with the corresponding restriction enzyme pairs. The resulting construct comprised the amino acid sequence set forth in SEQ ID NO: 147 and was also tagged with a 6-His motif (SEQ ID NO: 205) at the N-terminus of the protein to facilitate purification. The final plasmids were verified by restriction enzyme digestions and DNA sequencing.

The delivery constructs were expressed as follows: E. coli BL21(DE3) pLysS competent cells (Novagen, Madison, Wis.) were transformed using a standard heat-shock method in the presence of the appropriate plasmid to generate delivery construct expression cells, selected on ampicillin-containing media, and isolated and grown in Luria-Bertani broth (Difco; Becton Dickinson, Franklin Lakes, N.J.) with antibiotic, then induced for protein expression by the addition of 1 mM isopropyl-D-thiogalactopyranoside (IPTG) at OD 0.6. Two hours following IPTG induction, cells were harvested by centrifugation at 5,000 rpm for 10 min. Inclusion bodies were isolated following cell lysis and proteins were solubilized in the buffer containing 100 mM Tris-HCl (pH 8.0), 2 mM EDTA, 6 M guanidine HCl, and 65 mM dithiothreitol. Solubilized delivery construct was refolded in the presence of 0.1 M Tris, pH=7.4, 500 mM L-arginine, 0.9 mM GSSG, 2 mM EDTA. The refolded protein (SEQ ID NO: 147) was purified by Q SEPHAROSE Ion Exchange and Superdex 200 Gel Filtration chromatography (Amersham Biosciences, Inc., Sweden). The purity of proteins was assessed by SDS-PAGE and analytic HPLC (Agilent, Inc. Palo Alto, Calif.).

The delivery construct was evaluated to verify the proper folding with regard to its anticipated molecular size. Following induction, expressed protein was collected from inclusion bodies. The extent of expression of the delivery construct was verified by western blot, and the apparent molecular weight was compared to the calculated mass.

The results demonstrated stable and efficient production of functional delivery construct in high yield and purity.

Example 2

In Vitro Model for Assessment of Transport Across Epithelial Cell Monolayers

This example demonstrates an in vitro model designed to evaluate the transport properties of delivery constructs described herein.

FIG. 1 schematically shows a setup comprising an apical chamber above the epithelial cell monolayer and a basal chamber below such epithelial cell monolayer.

For apical to basolateral permeability, test articles (e.g., delivery construct, payload, etc.) were added to the apical (A) side and the amount of permeation was determined on the basolateral (B) side. For basolateral to apical permeability, test articles were added to the basolateral (B) side and amount of permeation was determined on the apical (A) side.

Data can be expressed as permeability ($P_{app}$) according to the following equation: $P_{app}=(dQ/dt)/(C_0*A)$. Q/dt is a rate of permeation, $C_0$ is initial concentration of test article, and A is the area of the monolayer. An efflux transport ratio ($R_e$) can be calculated according to the following equation: $(R_e)=P_{app}(B-A)/P_{app}(A-B)$. $R_e>2$ can indicate a potential substrate for P-gp or other active efflux transporters.

SMI-100 or Caco-2 cells can be used to assess the transcytosis function of a carrier or delivery construct in vitro.

For Caco-2 cells, an ELISA assay was performed to evaluate the ability of a carrier or delivery construct to move across Caco-2 cell monolayers via transcytosis. Caco-2 (ATCC HTB-37™) cells were maintained in 5% $CO_2$ at 37° C. in complete media: Dulbecco's modified Eagle's medium F12 (DMEM F12) supplemented with 10% fetal bovine serum, 2.5 mM glutamine, 100 U of penicillin/ml, and 100 μg of streptomycin/ml (Gibco BRL, Grand Island, N.Y.). Cells were fed every 2 to 3 days with this media (designated complete medium) and passaged every 5 to 7 days. For assays, cells were seeded into 24- or 96-well plates and grown to confluence.

Caco-2 cells were grown as confluent monolayers on collagen-coated 0.4-μm pore size polycarbonate membrane transwell supports (Corning-Costar, Cambridge, Mass.) and used 18-25 days after attaining a trans-epithelial electrical resistance (TER) of >250 Ω·cm2 as measured using a chopstick Millicell-ERS® voltmeter (Millipore). Apical to basolateral (A→B) transport of a carrier or delivery construct across these monolayer was determined by measuring the amount of transported protein at certain time points (e.g., 15, 30, and 45 minutes) after a e.g., 4.7 nM, 23.6 nM and 236 nM apical application of delivery construct at 37° C. TER measurements and the extent of 10 kDa fluorescent dextran (measured using an HPLC size exclusion protocol) were used to verify monolayer barrier properties during the course of the study. The extent of transport of the delivery construct was determined by titration of collected media in the cell-based cytotoxicity assay. Transported delivery construct was measured by enzyme linked immunosorbant assay (ELISA) using antibodies (e.g., anti-carrier or anti-payload, such as an anti-IL-22 antibody) for capture and detection.

Confluent monolayers of human small intestinal tissues (SMI-100, MatTek Corporation; Ashland, Mass., USA) established on cell culture inserts were allowed to stabilize for 24 h at 37° C. prior to use. Only inserts having a trans-epithelial electric resistance (TEER) of >400 Ω·cm² were considered to have sufficient monolayer integrity for use in studies. A secondary verification of monolayer integrity was performed by assessing suppression of 70 kD dextran transport. The chambers were washed once with transport buffer (PBS). Test molecules (e.g., delivery constructs, payloads, etc.), prepared at a concentration of 20 μg/mL, were applied to the apical surface of inserts in 100 μL volumes. Basolateral volumes of 500 μL PBS were replaced at each time point for transport studies. Each experimental condition was performed in triplicate.

Example 3

Carrier-Mediated Transport of IL-22 Across Polarized Gut Epithelial Cells

This example demonstrates that a carrier of SEQ ID NO: 134 can transport IL-22 payload (SEQ ID NO: 142) across polarized gut epithelial cells in vitro. This example further demonstrates that the carrier with SEQ ID NO: 134 can transport biologically active IL-22 payload across polarized gut epithelial cells and to the lamina propria in vivo.

Transport of delivery construct (SEQ ID NO: 147) across Caco-2 cell monolayers and small intestine epithelial tissue (also referred to herein as SMI-100) was tested by applying the delivery construct to the apical membrane of the epithelial cells, according to EXAMPLE 2 and as illustrated in FIG. 1 for apical (A) to basal (B) transport. Experiments were run in triplicates and samples from the basolateral chamber were collected at 15, 30, and 45 minutes after apical application to determine the amount of transported protein. The amount of transcytosed protein was measured using ELISA assays.

The data in FIG. 2 and FIG. 3 shows that a carrier with SEQ ID NO: 134 when coupled to IL-22, resulted in the transportation of IL-22 payload (SEQ ID NO: 142) across both Caco-2 (FIG. 2) and SMI-100 (FIG. 3) monolayers in a time-dependent manner, and that the delivery construct resulted in about 2-3 fold more IL-22 crossing the epithelial cells when compared to an IL-22 (SEQ ID NO: 143) that was not coupled to a carrier.

For in vivo experiments, transcytosis was tested using male Wistar rats. Male Wistar rats were housed 3-5 per cage with a 12/12 h light/dark cycle and were about 225-275 g (approximately 6-8 weeks old) when placed on study. Experiments were conducted during the light phase using a non-recovery protocol that uses continuous isoflurane anesthesia. A 4-5 cm midline abdominal incision that exposed mid-jejunum regions was conducted. Stock solutions at $3.86\times10^{-5}$M of delivery construct were prepared in phosphate buffered saline (PBS), with 50 μL (per 250 g rat) being administered by intraluminal injection (ILI) using a 29-gauge needle. The injection site mesentery was then marked with a permanent marker. At study termination, a 3-5 mm region that captured the marked intestine segment was isolated and processed for microscopic assessment.

The results of the transcytosis activity of the delivery construct with SEQ ID NO: 147 are shown in FIG. 4, demonstrating that significant amounts of IL-22 payload (SEQ ID NO: 142) crossed an intact and polarized gut epithelium in vivo when provided as part of a delivery construct that includes a carrier derived from Cholix. This microscopy image shows transportation of the IL-22 payload (SEQ ID NO: 142) from the apical site of the gut epithelium (highlighted by white arrow #1) to the basal site of the epithelial cells and into the lamina propria (3) (abbreviated as "l.p.") after luminal application of the delivery construct of SEQ ID NO: 147 to the jejunum of Wistar rats. The image further shows that the IL-22 interacted and bound to a significant extent to IL-22 receptors located on cells within the lamina propria and on the outer basal membrane of the polarized epithelium (highlighted by white arrows #2), demonstrating the IL-22 payload was biologically active after transport. IL-22 localization is indicated by white arrows and green fluorescence, blue fluorescence indicates DAPI staining.

Moreover, FIG. 5 shows that the delivery constructs consisting of the amino acid sequences set forth in SEQ ID NO: 147 and SEQ ID NO: 148 were detected at the basolateral compartment after transcytosis. Analysis of the western blot experiments confirms that both delivery constructs were unaltered.

Follow-on experiments also showed that transcytosis of delivery constructs comprising a Cholix derived carrier can depend on the presence of both GRP75 (FIG. 6) and basement membrane-specific heparan sulfate proteoglycan core protein (HSPG) (FIG. 7) (also referred to herein as "perlecan"). FIG. 6 and FIG. 7 show that transcytosis function was significantly reduced in Caco-2 cells that lacked GRP75 (FIG. 6, i.e., Caco-$2^{GRP75-}$ cells) and HSPG (FIG. 7, i.e., Caco-$2^{HSPG-}$ cells), respectively. This indicates that both GRP75 and HSPG are TRIPs that a Cholix derived carrier can interact with during apical to basal transcytosis.

Together, these data demonstrate that the Cholix derived carriers described herein efficiently (e.g., at least 5%, 10%, 20%, 25%, or 50% of material applied to the apical surface) transport therapeutic payload such as IL-22 across polarized epithelial layers, with significantly increased transport rates and overall transport efficiency (e.g., at least about 2-3 fold increase) compared to the payload alone.

Example 4

In Vivo Transport Studies into Polarized Epithelial Cells Using of Cholix Derived Carriers This example demonstrates the capability of truncated Cholix derived carriers to transport payload into polarized epithelial cells.

Figure 8:
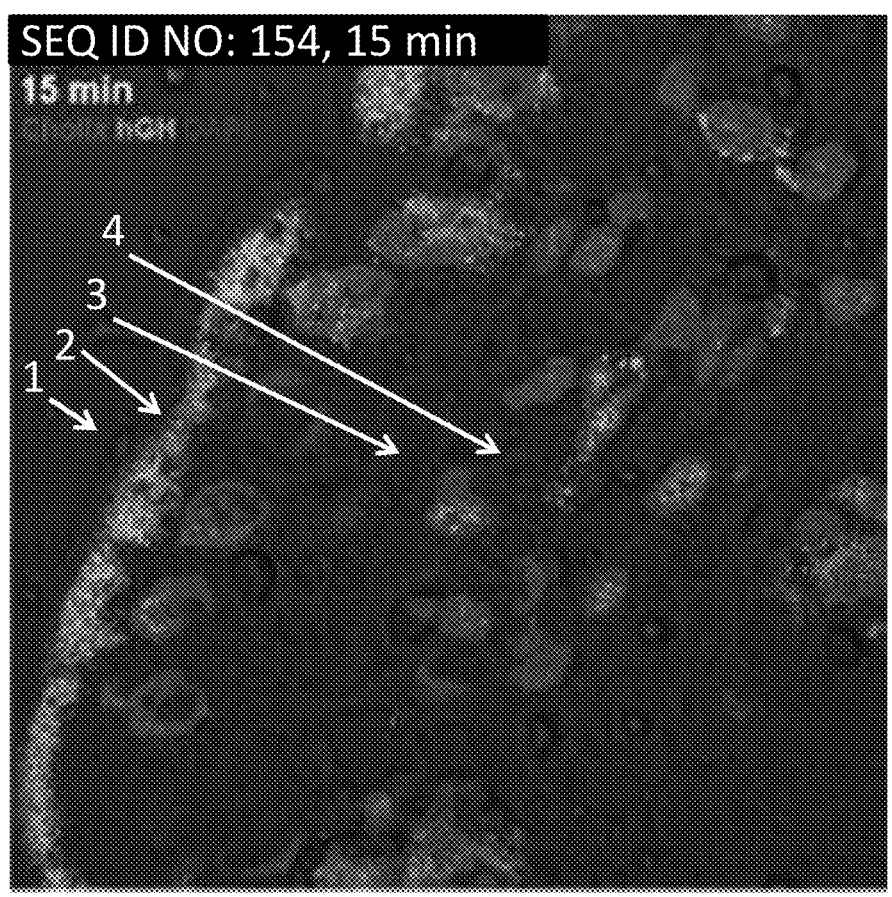

FIG. 8 depicts fluorescence microscopic detection of a delivery construct (SEQ ID NO: 154) in apical compartments (highlighted with white arrow #2) within epithelial cells 15 min after intra-luminal injection of the construct using a rat intra-luminal injection model (white arrow #1 highlights the apical surface, white arrow #3 highlights the basal membrane, and white arrow #4 highlights the lamina propria). The data demonstrates that a carrier derived from Cholix$^{41-187}$ (e.g., SEQ ID NO: 137) is capable of transporting payload to apical compartments of epithelial cells, but not across epithelial cells. Red fluorescence shows localization of a Cholix carrier, green fluorescence shows localization of hGH (SEQ ID NO: 146), and blue fluorescence indicates DAPI staining.

Figure 9:
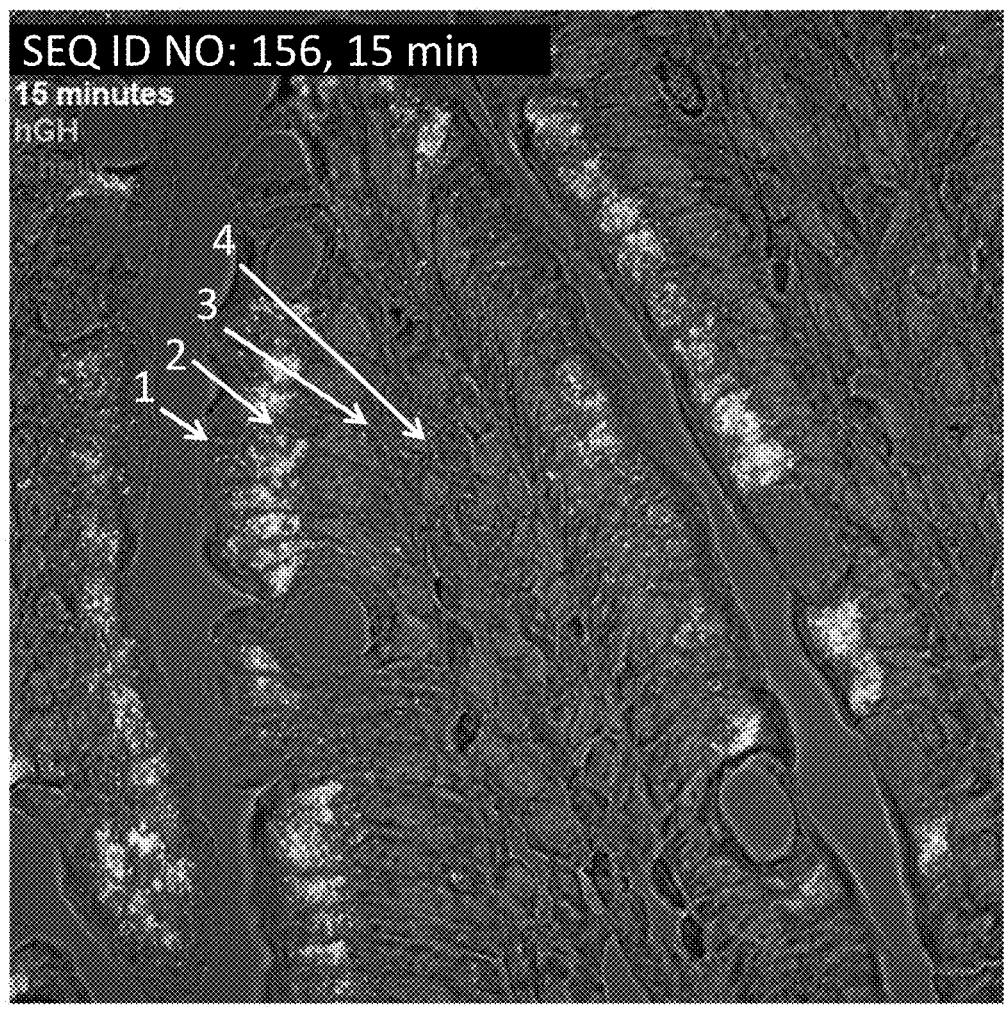

FIG. 9 depicts fluorescence microscopic detection of a delivery construct (SEQ ID NO: 156) in apical compartments (highlighted with white arrow #2) of epithelial cells 15 min after intra-luminal injection using a rat intra-luminal injection model (white arrow #1 highlights the apical surface, white arrow #3 highlights the basal membrane, and white arrow #4 highlights the lamina propria). The data demonstrates that a carrier derived from Cholix$^{40-205}$ (SEQ ID NO: 138) is capable of transporting payload (e.g., hGH) to apical compartments of epithelial cells, but not across epithelial cells into the lamina propria. These data further suggest that residues 1-40 of SEQ ID NO: 1 can play a role in transcytosis but may not be required for endocytosis of a Cholix carrier. Red fluorescence shows localization of a Cholix carrier, green fluorescence shows localization of hGH (SEQ ID NO: 146), and blue fluorescence indicates DAPI staining.

Figure 10A:
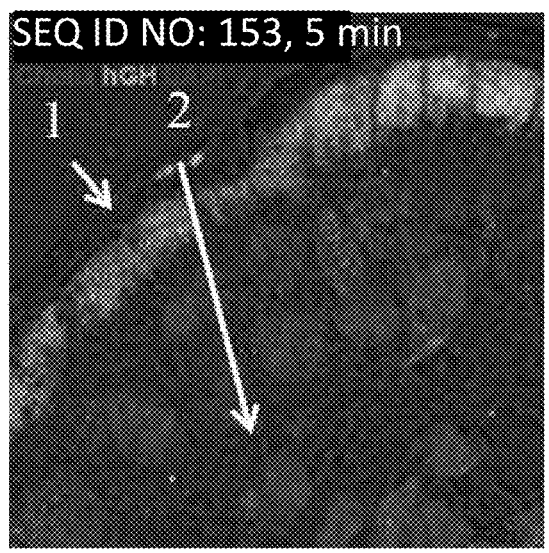
FIG. 10B depicts fluorescence microscopic detection of a delivery construct (SEQ ID NO: 153) 10 min after intraluminal injection. The data demonstrate that the carrier transported the hGH payload from apical compartments to supranuclear and basal compartments over time.
FIG. 10C depicts fluorescence microscopic detection of a delivery construct (SEQ ID NO: 153) 15 min after intraluminal injection. The data demonstrate that the carrier transported the payload from apical compartments to supranuclear and basal compartments over time.
Figure 10B:
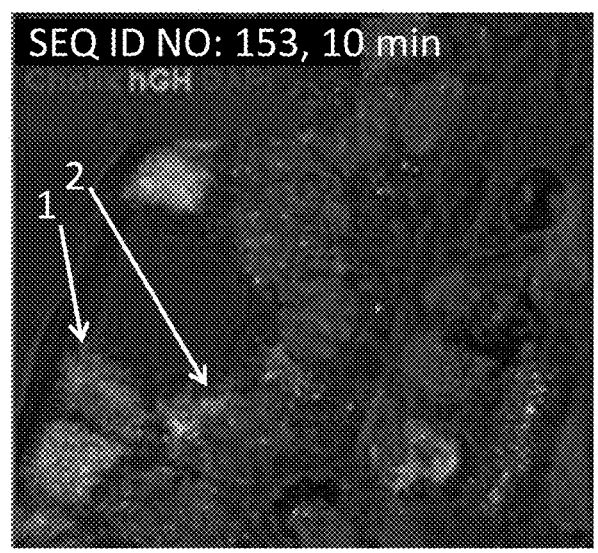
Figure 10C:
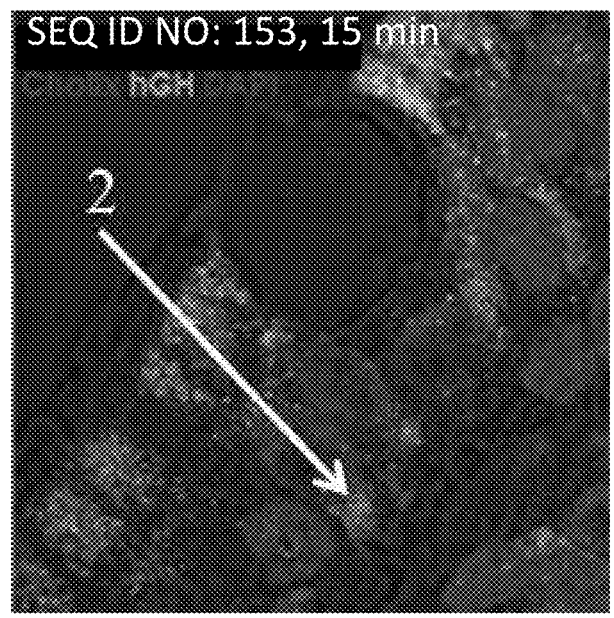

FIG. 10A depicts fluorescence microscopic detection of a delivery construct (SEQ ID NO: 153) in apical compartments inside epithelial cells 5 min after intra-luminal injection of the delivery construct to rat jejunum. In FIGS. 10A-10C, red fluorescence shows localization of a Cholix carrier, green fluorescence shows localization of hGH (SEQ ID NO: 146), and blue fluorescence indicates DAPI staining; white arrow #1 highlights the apical compartments, and white arrow #2 highlights supranuclear compartments.

FIG. 10B depicts fluorescence microscopic detection of a delivery construct (SEQ ID NO: 153) 10 min after intra-luminal injection. The data demonstrate that the carrier transported the hGH payload from apical compartments to supranuclear and basal compartments over time.

FIG. 10C depicts fluorescence microscopic detection of a delivery construct (SEQ ID NO: 153) 15 min after intra-luminal injection. The data demonstrates that the carrier transported the payload from apical compartments to supranuclear and basal compartments over time.

These data demonstrated that Cholix derived carriers with C-terminal truncations at position 187 or 205 of SEQ ID NO: 1, and an N-terminal truncation at positions 40 or 41 of SEQ ID NO: 1, respectively, can transport payload into polarized epithelial cells. These data further suggested that the N-terminal 39 amino acids of Cholix carrier can play a role in transcytosis but are not sufficient for transport to basolateral intracellular vesicles, and that 1-187 is not sufficient for transcytosis but sufficient to transport payload into epithelial cells (e.g., into supranuclear and basal compartments).

Example 5

In Vitro Transcytosis Function of Cholix Derived Carriers

This example demonstrates the in vitro apical to basal transcytosis function of various Cholix derived carriers that were coupled to human growth hormone via a spacer using recombinant expression as described above in EXAMPLE 1.

The following carriers were evaluated for their ability to cross polarized human small intestinal epithelial cell monolayers (TABLE 10):

TABLE 10

| Tested Delivery Constructs | |
|---|---|
| SEQ ID NO | Cholix Notation (relative to SEQ ID NO: 1) |
| SEQ ID NO: 151 | M + Cholix$^{1-134}$-(G$_4$S)$_3$-hGH |
| SEQ ID NO: 152 | M + Cholix$^{1-151}$-(G$_4$S)$_3$-hGH |
| SEQ ID NO: 153 | M + Cholix$^{1-187}$-(G$_4$S)$_3$-hGH |
| SEQ ID NO: 154 | M + Chx$^{41-187}$-(G$_4$S)$_3$-hGH |
| SEQ ID NO: 155 | M + Cholix$^{1-206}$-(G$_4$S)$_3$-hGH |
| SEQ ID NO: 156 | M + Cholix$^{40-205}$-(G$_4$S)$_3$3-hGH |
| SEQ ID NO: 157 | M + Cholix$^{1-245}$-(G$_4$S)$_3$-hGH |
| SEQ ID NO: 158 | M + Cholix$^{1-251}$-(G$_4$S)$_3$-hGH |
| SEQ ID NO: 159 | M + Cholix$^{1-266}$-(G$_4$S)$_3$3-hGH |

FIGS. 11A-11B depict apical-to-basal transport of human growth hormone (hGH, SEQ ID NO: 190) alone compared to using hGH coupled to carriers. The carrier lengths are indicated by the C-terminal truncation relative to reference SEQ ID NO: 1 (i.e., "134" indicates a carrier having the residues 1-134 of SEQ ID NO: 1). All carriers further included an N-terminal methionine. Western blotting for hGH qualitatively assessed the capacity of these proteins to undergo apical-to-basal transport across polarized monolayers of primary human small intestinal epithelial cells in vitro after 2 h. The amounts of apically-applied materials were equivalent on a molar basis for hGH content, and basal collections were concentrated ~10-fold prior to analysis.

FIG. 11A shows a comparison of the apical to basal transport of hGH (SEQ ID NO: 190) alone relative to that measured for the delivery constructs with the sequence set forth in SEQ ID NO: 151-SEQ ID NO: 154 and SEQ ID NO: 159 with C-terminal truncations at positions 134, 151, 187, 41-187, and 266, respectively, of SEQ ID NO: 1. The data demonstrated that Cholix carriers with C-terminal truncations at positions 134, 151, 187 of SEQ ID NO: 1, or an N-terminal truncation at 41 and a C-terminal truncation at 187 of SEQ ID NO: 1, showed significantly lower apical-to-basal transport of conjoined hGH as compared to the construct with a Cholix carrier (SEQ ID NO: 159) with a C-terminal truncation at 266 of SEQ ID NO: 1.

FIG. 11B shows that the delivery constructs with SEQ ID NO: 155 and SEQ ID NO: 157—SEQ ID NO: 159 including Cholix carriers with C-terminal truncations at positions 206 (SEQ ID NO: 131), 245 (SEQ ID NO: 132), 251 (SEQ ID NO: 133), and 266 (SEQ ID NO: 134), respectively, of SEQ ID NO: 1 demonstrated efficient apical-to-basal transport of conjoined hGH (SEQ ID NO: 146). While carriers with Cholix C-terminal truncations at positions 245 and 251 demonstrated apical-to-basal transport of hGH (SEQ ID NO: 146) comparable to that of the carrier with the C-terminal truncation at position 266, the carrier with a Cholix C-terminal truncation at position 206 showed a significant enhancement of apical-to-basal transport of hGH compared to the carriers with C-terminal truncations at positions 245, 251, and 266.

These results suggested that residues 1-266 of Cholix were sufficient for apical-to-basal transport, and that it can function as a transcytosis element to deliver various heterologous payloads across epithelial cells. Additionally, it was demonstrated that elements within the first 206 amino acid residues of the Cholix polypeptide consisting of the sequence set forth in SEQ ID NO: 1 were sufficient for the transcytosis function and thus can be used to efficiently (e.g., at least 5%, 10%, 20%, 25%, or 50% of material applied to the apical surface) shuttle heterologous payload molecules such as therapeutic and/or diagnostic payloads across an epithelial cell layer (e.g., the gut epithelium), thereby enabling oral administration of payload that would otherwise only be administrable via parenteral administration routes (e.g., intravenously of subcutaneously).

Example 6

In Vivo Transcytosis Function of Cholix Derived Carriers

This example demonstrates the in vivo apical to basal transcytosis function of various Cholix derived carriers that were coupled to human growth hormone via a spacer using recombinant expression as described above in EXAMPLE 1.

Selected Cholix carriers shown in TABLE 10 of EXAMPLE 5 were examined for their capacity for transcytosis in vivo following ILI into rat jejunum.

The data obtained in these experiments showed the extent of apical to basal transport across polarized gut epithelial cells in rat jejunum of six delivery constructs, each including a different Cholix carrier. Localization of the Cholix carrier (red fluorescence) and hGH (green fluorescence) was demonstrated (FIGS. 12A-12F) by immunofluorescence microscopy using polyclonal anti-Cholix and monoclonal anti-hGH antibodies, respectively. White arrows indicate the apical membrane, "l-p" refers to lamina propria, "GC" refers to goblet cells, and open arrows indicates delivery construct present in the lamina propria.

FIG. 12A shows the extent of apical to basal transport 15 min after intraluminal injection of a delivery construct (SEQ ID NO: 151) including a Cholix carrier (SEQ ID NO: 140) coupled to hGH (SEQ ID NO: 146). FIG. 12A shows that the carrier did not enable the delivery construct to enter epithelial cells, suggesting that a functional sequence fragment having amino acid residues 134-151 of SEQ ID NO: 1 can play a role in endocytosis into polarized epithelial cells (in contrast, FIG. 12B demonstrates that the carrier with SEQ ID NO: 139 enabled cellular entry of the respective delivery construct via endocytosis).

FIG. 12B shows the extent of apical to basal transport 15 min after intraluminal injection of a delivery construct (SEQ ID NO: 152) including a Cholix carrier (SEQ ID NO: 139) coupled to hGH (SEQ ID NO: 146) as demonstrated by immunofluorescence microscopy. FIG. 12B shows that this construct did enter epithelial cells (as opposed to the construct with SEQ ID NO: 151 described in FIG. 12A) but mainly remained in apical and, to some extent, in basal vesicular pools but did not enter the lamina propria, thereby enabling delivery of payload to apical and basal compartments of an epithelial cell.

FIG. 12C shows the extent of apical to basal transport 15 min after intraluminal injection of a delivery construct (SEQ ID NO: 153) including a Cholix carrier (SEQ ID NO: 136) coupled to hGH (SEQ ID NO: 146) as demonstrated by immunofluorescence microscopy. FIG. 12C shows that this construct entered epithelial cells, reached apical and basal compartments and also reached a supra-nuclear region of the cell, yet still remained inside the epithelial cell, suggesting that the sequence fragment consisting of amino acid residues 152-187 of SEQ ID NO: 1 can allow access and delivery to supranuclear regions, as well as allow localization in basal compartments.

FIG. 12D shows the extent of apical to basal transport 15 min after intraluminal injection of a delivery construct (SEQ ID NO: 154) including a Cholix carrier (SEQ ID NO: 137) coupled to hGH (SEQ ID NO: 146) as demonstrated by immunofluorescence microscopy. FIG. 12D shows that this construct entered epithelial cells but remained in apical compartments and did not appear to reach basal or supranuclear compartments.

FIG. 12E shows the extent of apical to basal transport 15 min after intraluminal injection of a delivery construct (SEQ ID NO: 155) including a Cholix carrier (SEQ ID NO: 131) coupled to hGH (SEQ ID NO: 146) as demonstrated by immunofluorescence microscopy. FIG. 12E shows that this construct completed the transcytosis process as indicated by delivery constructs reaching the lamina propria (see open arrow), suggesting that the sequence fragment consisting of amino acid residues 188-206 of the sequence set forth in SEQ ID NO: 1 can enable the carrier (and constructs comprising such carrier) to engage with basal recycling processes that allow release of the carrier or respective construct from the epithelial cell into a basolateral compartment (e.g., lamina propria).

FIG. 12F shows the transport across rat jejunum epithelial monolayers in vivo 15 min after intraluminal injection of a delivery construct (SEQ ID NO: 159) including a Cholix carrier (SEQ ID NO: 134) coupled to hGH (SEQ ID NO: 146) as demonstrated by immunofluorescence microscopy. FIG. 12F shows that this construct completed the transcytosis process as indicated by delivery constructs reaching the lamina propria (see open arrow).

Thus, these results are in line with data obtained from in vitro transcytosis experiments described in EXAMPLE 5 and demonstrated that carriers with a C-terminal truncation at any one of residues 206-266 of the Cholix sequence set forth in SEQ ID NO: 1 can rapidly (e.g., at least $10^{-6}$ cm/sec, $10^{-5}$ cm/sec) and efficiently (e.g., at least 5%, 10%, 20%, 25%, or 50% of material applied to the apical surface) transport payload molecules (e.g., therapeutic proteins) across epithelial cells (e.g., across polarized gut epithelial cells of a subject). Moreover, these results showed that carriers with a C-terminal truncation at any one of residues 151-187 of the Cholix sequence set forth in SEQ ID NO: 1 and/or an N-terminal truncation at any one of residues 1-40 of SEQ ID NO: 1 can be used to deliver various heterologous payloads into epithelial cells.

Based on these data, the following functional Cholix sequence fragments were identified for carriers derived from the Cholix polypeptide of SEQ ID NO: 1.

TABLE 11

Exemplary Cholix Sequence Fragments
and their Function within Cholix
Polypeptide of SEQ ID NO: 1

| SEQ ID NO | Sequence | Function |
|---|---|---|
| SEQ ID NO: 165 | $_{135}$DQQRNIIEV PKLYSIDL$_{151}$ | Endocytosis |
| SEQ ID NO: 166 | $_{1}$VEEALNIFDECRSP CSLTPEPGKPIQSK LSIPSDVVLDEG$_{40}$ | Apical-Basal translocation |
| SEQ ID NO: 167 | $_{151}$LDNQTLEQWKTQG NVSFSVTRPEHNIAI SWPSVSYKA$_{187}$ | Supranuclear localization |
| SEQ ID NO: 168 | $_{188}$AQKEGSRHKR WAHWHTGLA$_{206}$ | Basal release |

Example 7

Cholix Derived Carriers Co-localize with Rab11a

This example demonstrates that Cholix derived carriers co-localize with Ras-related protein Rab11a (Rab11a or Rab11). Co-localization of a carrier with Rab11a can occur on the apical side or the basal side of an epithelial cell. It was shown that co-localization of the carrier with Rab11a at the apical side of an epithelial cell can direct the carrier to apical recycling endosomes and/or into the intestinal lumen. Co-localization of the carrier with Rab11a at the basal side of an epithelial cell indicates that the carrier can utilize basal recycling mechanisms for its release from the basal cell membrane into basolateral compartments (e.g., lamina propria).

The co-localization of four delivery constructs with Rab11a was tested by intraluminal injection (ILI) of 50 µL of $3.86 \times 10^{-5}$ M solutions in PBS of the four different delivery constructs. Such delivery constructs consisted of the amino acid sequences set forth in SEQ ID NOs: 152-154 and SEQ ID NO: 159.

FIG. 13A, FIG. 13B, and FIG. 13C show that the delivery constructs with SEQ ID NO: 154, SEQ ID NO: 152, and SEQ ID NO: 153, respectively, co-localized with Rab11a on the apical side of the epithelial cells. The data also show that the constructs with SEQ ID NO: 152 and SEQ ID NO: 154 did not significantly localize at the basal side, but remained mainly at the apical side. The construct with SEQ ID NO: 153 did localize at both the apical and basal side, however only co-localized with Rab11a at the apical side and not at the basal side (see also, sub-images 3a and 3b of FIG. 13C showing increased localization at the apical site compared to the basal site). Together, these results suggested that carriers that are not capable of apical to basal transcytosis can enter apical recycling systems within epithelial cells, as demonstrated by co-localization with Rab11a at the apical site. Measurements were carried out 15 min after intraluminal injection. Green fluorescence shows localization of hGH, red fluorescence shows localization of Rab11a (or Rab11), and blue fluorescence indicates DAPI staining (experimental description identical for FIG. 13D).

FIG. 13D shows that the delivery construct with SEQ ID NO: 159 co-localized with Rab11a on the basal side but not significantly on the apical side the polarized epithelial cells. This suggested that carriers capable of transcytosis can utilize the basal recycling system for their release from the epithelial cell into the lamina propria (see also, sub-images 4a and 4b of FIG. 13D showing increased localization at the apical site compared to the basal site).

These data demonstrated that a functional fragment of Cholix that enables basal co-localization with Rab11a to access the basal recycling system can reside at least within amino acid residues 187-266 of SEQ ID NO: 1.

Moreover, these data enable the rational design of carriers that can transport payloads to various locations inside an epithelial cell or across such epithelial cell. For examples, Cholix derived carriers comprising or consisting of amino acid residues 1-151, 1-187, 41-187, 41-187, 40-205 or 41-205 of the amino acid sequence set forth in SEQ ID NO: 1 can be used for intra-epithelial payload delivery, whereas Cholix derived carriers comprising amino acid residues 1-266 of SEQ ID NO: 1 can be used to transport payload across such epithelial cell barrier and into the lamina propria.

Example 8

Cell Compartment Specific Protein Markers for Assessing Type and Location of Cholix Carrier Interaction Partners (TRIPs)

This example describes epithelial cell compartment specific protein markers that were used to determine proteins that interact with Cholix derived carriers during endocytosis and/or transcytosis processed.

The following TABLE 12 below shows exemplary cell compartment specific protein markers used herein. For example, Cholix derived delivery constructs comprising an IL-10 as the heterologous payload were followed during experiments using either a monoclonal antibody (mAb) against IL-10 and/or a polyclonal antibody (pAb) raised against the Cholix carrier (e.g., one that comprises residues 1-266 or 1-386 of SEQ ID NO: 1).

TABLE 12

Cell Compartment Specific Protein Markers

| Target | pAb/ mAb | Species reactivity | Host | Dilution for IHC (P) | Notes | Storage | Cat. # |
|---|---|---|---|---|---|---|---|
| Cholix carrier | pAb | | Rabbit | 1/500 | Whole antiserum | −20° C. | — |
| IL-10 | mAb; pAb | Human | Mouse, Goat | 1/25 | | −20° C. | — |
| EEA1 | pAb | Mouse, rat, human | Rabbit | 1/200 | Early endosome | −20° C. | Ab2900 |

TABLE 12-continued

Cell Compartment Specific Protein Markers

| Target | pAb/ mAb | Species reactivity | Host | Dilution for IHC (P) | Notes | Storage | Cat. # |
|---|---|---|---|---|---|---|---|
| Rab7 | mAb | Mouse, rat, human | Rabbit | 1/100 | Late endosome | −20° C. | Ab1267712 |
| Rab11a | pAb | Mouse, rat, human, rabbit, dog | Rabbit | 1/500 | Recycling endosome | −20° C. | Fisher71-5300 |
| LAMP1 | pAb | Mouse, rat, human | Rabbit | 1/500 | Lysosome marker | −20° C. | Ab24170 |
| GM130 | pAb | Mouse, rat, human | Rabbit | 1/500 | Cis-Golgi | −20° C. | — |
| Giantin | mAb | Rat, human | Mouse | 1/20 | Golgi | −20° C. | Ab37266 |
| 58K Golgi protein | mAb | Mouse, rat, human | Mouse | 1/100 | Golgi | −20° C. | Nb600-4512 |
| TGN38 | mAb | Mouse, rat, human | Mouse | 1/1000 | Trans-Golgi | −20° C. | Nb300-575 |
| Calnexin | pAb | Mouse, rat, human | Rabbit | 1/500 | Endoplasmic reticulum | −20° C. | Ab22595 |
| Clathrin | mAb | Mouse, rat, human | Mouse | 1/500 | Clathrin-mediated endocytosis | −20° C. | Ab2731 |

Example 9

In Vitro Transcytosis Studies Reveal Transport Receptors Interaction Partners (TRIPs) for Cholix Derived Carriers This example demonstrates the determination of TRIPs that Cholix derived carriers interact with during transcytosis across polarized epithelial cells. This example further demonstrates critical interaction partners that can play a role in Cholix transcytosis.

FIGS. 14A-14D show knockout effects of K8, HSPG (perlecan), and GRP75, respectively, on the transcytosis function of a delivery construct with SEQ ID NO: 150 that includes a Cholix derived carrier with the sequence set forth in SEQ ID NO: 134 coupled to hGH (SEQ ID NO: 146) via a spacer which sequence is set forth in SEQ ID NO: 177. Stable cell lines of Caco-2 cells lacking the expression of specific candidate proteins K8 (Caco-2$^{K8}$), HSPG (Caco-2$^{HSPG-}$), and GRP75 (Caco-2$^{GR75-}$) were used as monolayers in vitro to verify their involvement in carrier (e.g., Cholix carriers) transcytosis via active and selective endogenous transport mechanisms.

Caco-2 cells, parental or K8, HSPG (perlecan), or GRP74 knockdown (KO) stable cells, were seeded at 1.5×10$^5$ cells/ml in each transwell. On day 18, 100 µl of PBS containing delivery construct (SEQ ID NO: 150) at 20 µg/ml or equal molar control hGH (SEQ ID NO: 190) was added onto apical side and 500 µl of PBS in the basal chamber. The amount of proteins in the basal solution after 1 hr at 37° C. was analyzed by western blotting. Blot was probed with an anti-hGH mAb.

FIG. 14A shows that K8 knockout does not significantly reduce transcytosis function of the delivery construct (SEQ ID NO: 150).

FIG. 14B shows that HSPG (perlecan) knockout does significantly reduce transcytosis function of the delivery construct (SEQ ID NO: 150).

FIG. 14C shows that GRP75 knockout does significantly reduce transcytosis function of the delivery construct (SEQ ID NO: 150).

Next, the pH-dependency of the interaction between a Cholix protein and GRP75 was evaluated. FIG. 15A shows Biacore™ binding interactions (e.g., surface plasmon resonance) used to examine such pH-dependency of Cholix carrier-GRP75 interactions. To that end, biotin was coupled to the C-terminus of full-length Cholix protein which sequence is set forth in SEQ ID NO: 1 and subsequently attached to a surface (e.g., chip surface, plastic 96-well plate, etc.) using the biotin-streptavidin bioconjugation and incubated with purified GRP75 protein in buffer solutions at pH 5.5, 6.5, and 7.5, respectively. Highest binding affinity was for this interaction was measured at pH 6.5. FIG. 15A shows that the affinity of the Cholix protein for GPR75 is about 20-25-fold higher at pH 6.5 compared to pH 7.5 or pH 5.5.

Moreover, FIG. 15B shows the pH-dependence of the interaction of a Cholix-derived carrier (SEQ ID NO: 189) with the apical receptor (e.g., TMEM132), the lysosome avoidance receptors (e.g., GRP75), traffic receptor (e.g., ERGIC-53), and basal receptor (e.g., perlecan). This pH dependency of receptor interaction indicates that a Cholix-derived carrier can sequentially and dependent on its location interact with certain receptors. For example, these data show that a Cholix-derived carrier has a significantly higher affinity to endocytosis and early trafficking receptors such as apical entry receptor and lysosome avoidance receptor at pH 7.5. Once the pH drops to about 5.5, the affinity of the Cholix carrier for these early trafficking receptors decreases, while its affinity for the apical-basal trafficking receptor ERGIC-53 and the basal release protein perlecan significantly increases at that pH, allowing the Cholix carrier to "be handed off" to trafficking and basal release receptors during the vesicular transcytosis process.

FIG. 16 shows significant and sequential Biacore™ binding interactions of the full-length Cholix protein which sequence is set forth in SEQ ID NO: 1 with perlecan and GRP75, demonstrating that Cholix interacts with both proteins. For the binding experiment, 20 µl of cholix-biotin protein at 50 nM was captured on Biacore SA chip surface. 60 µl of human perlecan (HSPG) protein at 200 nM was injected through the chip surface at the speed of 30 µl/min. 60 µl of human GRP75 protein at 100 nM was then injected through the chip surface at the speed of 30 µl/min. Chip surface was regenerated by injecting 50 µl of 10 mM Glycine at pH 1.5 to remove all bound proteins.

FIG. 17 shows significant and sequential Biacore™ binding interactions of the full-length Cholix protein which sequence is set forth in SEQ ID NO: 1 with GRP75, perlecan, and TMEM132A, demonstrating that Cholix interacts with all three proteins. For binding experiments, 20 µl of cholix-biotin protein at 50 nM was captured on Biacore SA chip surface. 30 µl of human GRP75 protein at 100 nM was injected through the chip surface at the speed of 30 µl/min. 60 µl of a human perlecan protein at 200 nM was then injected through the chip surface at the speed of 30 µl/min followed by 30 µl of human TMEM132A protein at 200 nM. Chip surface was regenerated by injecting 50 µl of 10 mM Glycine at pH1.5 to remove all bound proteins.

These data demonstrated that GRP75 and perlecan can play a role in transcytosis function of Cholix derived carriers, and the Cholix proteins bind GRP75, perlecan, TMEM132 proteins.

Example 10

Cholix Derived Carriers that Transcytose Across Polarized Epithelial Cells May not Co-Localize with LAMP1+ or Rab7+ and can be Directed Away from Lysosomes During Apical to Basal Transcytosis This example demonstrates that carriers derived from a Cholix polypeptide are directed away from lysosomes during transcytosis and thus do not interact with the lysosomal recycling pathway that allows the carrier to transcytose unaltered and fully functional across polarized epithelial cells.

FIGS. 18A-18D show the fate of human growth hormone (hGH, SEQ ID NO: 190) that was administered by intraluminal injection (ILI, luminal surface is indicated as a white arrow in FIG. 18A-FIG. 18F) into rat jejunum in vivo that was evaluated first as a potential control experiment expecting transport of hGH to lysosomes after cellular uptake.

FIG. 18A shows that localization of hGH (SEQ ID NO: 190) 15 minutes post injection (ILI) was limited to a small population of vesicles in the apical region of epithelial cells as demonstrated by green immunofluorescence detection.

FIG. 18B, FIG. 18C, and FIG. 18D show that 15 min post ILI, hGH (SEQ ID NO: 190) was co-localized with lysosomal-associated membrane protein 1 (LAMP1, red fluorescence) (FIG. 18B) and Ras-related protein (Rab7, purple fluorescence) (FIG. 18C) with about the same frequency and characteristics of resident LAMP1+, Rab7+ lysosomes (FIG. 18D), indicating that hGH was directed to the lysosomal destructive (e.g., recycling) pathway shortly after uptake into the epithelial cells.

FIG. 18E and FIG. 18F show that a delivery construct (SEQ ID NO: 159) that includes a Cholix derived carrier (SEQ ID NO: 134) coupled to hGH (SEQ ID NO: 146) via a spacer (SEQ ID NO: 175), was directed away from the lysosomal pathway and thus did not show co-localization with either LAMP1 (FIG. 18E) or Rab7 (FIG. 18F), thereby enabling transcytosis of functional payload across polarized epithelial cells into the lamina propria.

FIG. 19A shows that coating protein I (COPI, red fluorescence) distribution was restricted to the luminal apical membrane and apical vesicular compartment of epithelial cells prior to luminal injection of a delivery construct (SEQ ID NO: 159) that includes a Cholix derived carrier (SEQ ID NO: 134) coupled to hGH (SEQ ID NO: 146) via a spacer (SEQ ID NO: 175). In comparison, FIG. 19B shows that apical intraluminal injection (ILI, luminal surface is indicated as a white arrow in FIG. 19A-FIG. 19D) of the delivery construct (SEQ ID NO: 159), induced COPI redistribution to a supra-nuclear location, indicating co-localization of the vesicles containing both the delivery construct with SEQ ID NO: 159 and COPI. Blue fluorescence indicates DAPI staining. Measurements in FIGS. 19A-19D were carried out 15 minutes post-ILI.

FIG. 19C shows that LMAN1 (green fluorescence) co-localized with COPI (red fluorescence) in the apical region (highlighted by white arrow) of polarized epithelial cells prior to injection of a delivery construct (SEQ ID NO: 159).

FIG. 19D shows that, following apical ILI (highlighted by white arrow) of a delivery construct (SEQ ID NO: 159), LMAN1 interacted and distributed with the delivery construct to the basal region of the epithelial cell, which is adjacent to the lamina propria (denoted as "l-p"). Thus, LMAN1 redistribution appears to be used by Cholix carriers to move from the apical side of the epithelial cell to a basal compartment.

A follow-up experiment showed that Cholix-derived carriers can utilize ERGIC proteins (e.g., ERGIC-53) to traffic from apical to basal compartments following endocytosis.

FIGS. 19E-19H show trafficking of a Cholix carrier (SEQ ID NO: 134) from apical (indicated by white arrow #1) to basal (indicated by white arrow #2) compartments in epithelial cells 5 (FIG. 19F), 10 (FIG. 19G), and 15 min (FIG. 19H) after luminal injection of a delivery construct (SEQ ID NO: 159) comprising a Cholix-derived carrier (SEQ ID NO: 134) coupled to an hGH (SEQ ID NO: 146) in rat jejunum. Cholix carrier localization is shown by green fluorescence, ERGIC receptor localization is shown by red fluorescence, and localization of ER-Golgi trafficking protein complex is shown by purple fluorescence; thus interaction of Cholix carrier and ERGIC receptor is shown by yellow fluorescence, interaction of Cholix carrier and ER-Golgi trafficking protein complex is shown by pink fluorescence, and interaction and/or co-localization of Cholix carrier, ERGIC receptor, and ER-Golgi trafficking protein complex is shown by white spots (overlay of green, red, and purple fluorescence). DAPI staining is indicated by blue fluorescence.

FIG. 19E shows untreated polarized gut epithelial cells.

FIG. 19F shows localization and interaction of the Cholix carrier (SEQ ID NO: 134) with ER-Golgi trafficking protein complex 5 minutes after luminal injection in apical compartment as indicated by pink fluorescence signal in apical compartments.

FIG. 19G shows trafficking of the Cholix carrier (SEQ ID NO: 134) in association with ERGIG-53 to the basal membrane 10 minutes after luminal injection followed by basal release of the carrier (and construct) into the lamina propria (gold arrow). These data demonstrated that Cholix-derived carriers utilized specific interactions with ERGIC proteins to "hijack" vesicular trafficking from apical to basal compartments of a polarized epithelial cell.

FIG. 19H shows increased amounts of Cholix carrier (SEQ ID NO: 134) present in the lamina propria 15 minutes after luminal injection.

FIGS. 19I-19K show that a Cholix carrier (SEQ ID NO: 134) utilized basal protein secretion mechanisms to traffic through a polarized epithelial cell into the lamina propria. The fluorescence microscopy images were acquired 15 min after luminal injection of a delivery construct (SEQ ID NO: 159) comprising a Cholix-derived carrier (SEQ ID NO: 134) coupled to an hGH (SEQ ID NO: 146) in rat jejunum, and showed that basal vesicles can contain Cholix carrier and ERGIC-53 receptor, Cholix carrier and basal secretion protein, or all three of Cholix carrier, ERGIC-53 receptor, and basal secretion protein. Cholix carrier localization is shown by green fluorescence (using an anti-Cholix carrier antibody), ERGIC-53 receptor localization is shown by red fluorescence, and localization of basal secretion protein is shown by purple fluorescence; thus interaction of Cholix carrier and ERGIC-53 receptor is shown by yellow fluorescence, interaction of Cholix carrier and basal secretion protein is shown by pink fluorescence, and interaction and/or co-localization of Cholix carrier, ERGIC-53 receptor, and basal secretion protein is shown by white spots (overlay of green, red, and purple fluorescence). DAPI staining is indicated by blue fluorescence.

FIG. 19I shows that basal compartment vesicles contained Cholix carrier (SEQ ID NO: 134) and ERGIC-53 receptor as indicated by yellow fluorescence.

FIG. 19J shows that basal compartment vesicles contained Cholix carrier (SEQ ID NO: 134) and basal secretion protein as indicated by pink fluorescence.

FIG. 19K shows that basal compartment vesicles contained Cholix carrier (SEQ ID NO: 134), ERGIC-53 receptor, and basal secretion protein as indicated by white spots (e.g., overlay of green, red, and purple fluorescence).

FIG. 20A shows the distribution of another endoplasmic reticulum-Golgi-intermediate compartment (ERGIC) element, SEC22b, in the absence of a delivery construct (SEQ ID NO: 159). In untreated (i.e., no injection of a delivery construct) tissues, SEC22b and LMAN1 extensively co-localized in the apical compartment while LMAN1 alone was separately observed close to the apical plasma membrane. In FIGS. 20A-20D, red fluorescence shows localization of LMAN1, purple fluorescence shows localization of SEC22b, green fluorescence shows localization of hGH, white arrow indicates the apical surface, and "G" indicates Goblet cells.

FIG. 20B shows that 5 minutes after ILI of a delivery construct (SEQ ID NO: 159) including a Cholix carrier (SEQ ID NO: 134) coupled to hGH (SEQ ID NO: 146), LMAN1, SEC22b, and hGH co-localized in the apical compartment but not significantly in basal compartments of epithelial cells.

FIG. 20C shows that 10 min post ILI, the delivery construct (SEQ ID NO: 159) and LMAN1 were observed to co-localize in the basal compartment of epithelial cells without SEC22b, confirming that LMAN1 interacted and moved with the delivery construct inside the vesicle from the apical to the basal vesicular compartment of epithelial cells.

FIG. 20D shows that the extent of delivery construct (SEQ ID NO: 159) and LMAN1 co-localizing in the basal compartment 15 min post ILI had increased, with a significant amount of hGH reaching the lamina propria over time.

FIG. 20E-FIG. 20H show the same tissue sections as described above and shown in FIG. 20A-FIG. 20D but showing only LMAN1 and SEC22b signals (no hGH signal). These demonstrated the profound redistribution of LMAN1 to the basal compartment without a redistribution of SEC22b in response to apical application of a delivery (SEQ ID NO: 159). These data further demonstrated that delivery constructs comprising a Cholix derived carrier can utilize endogenous Cholix trafficking pathways that allow rapid and efficient transport of payload across the gut epithelium by coupling such payload to the carrier.

Altogether, these data showed that Cholix-derived carriers utilized endogenous bacterial trafficking mechanisms to achieve apical to basal transcytosis, allowing such carriers and delivery constructs comprising such carriers to traffic from the intestinal lumen to the lamina propria without impairing the barrier function of a gut epithelium and without being enzymatically or chemically modified during such transport. This transepithelial transport mechanisms can enable oral administration of a therapeutic delivery construct comprising a Cholix-derived carrier coupled to a therapeutic payload and transport of the therapeutic payload across intact and polarized epithelial membranes.

Example 11

Surface Model of a Cholix Derived Carrier

This example shows structural sequence elements of a Cholix polypeptide with SEQ ID NO: 178.

FIGS. 21A-21E show an exemplary surface model of a Cholix derived carrier consisting of SEQ ID NO: 178 (includes amino acid residues 1-265 of SEQ ID NO: 1 and an N-terminal methionine) which was used to highlight selected regions of interest that can play a role in certain functionalities related to apical to basal transcytosis, as well as their relative position and proximity on the protein surface. Amino acid regions located within residues $V^1$ and $E^{39}$ are adjacent to surface exposed amino acids $D^{150}$-$K^{186}$ and $K^{186}$-$L^{205}$. Specifically, $L^{17}$-$I^{25}$ (region X1, SEQ ID NO: 160) and $T^{170}$-$I^{176}$ (region X2, SEQ ID NO: 161) coordinate to form a pocket surrounded by several negative charges. Similarly, $K^{186}$-$H^{202}$ (region X3, SEQ ID NO: 162) coordinates with $I^{31}$-$E^{39}$ (region X4, SEQ ID NO: 163) to form a continuous ridge structure. In addition, the surface model shows residues $D^{135}$-$N^{139}$ (region X5, SEQ ID NO: 164), and the asparagine residues (e.g., potential glycosylation sites) highlighted in purple.

FIG. 21A shows the amino acid sequence of a Cholix polypeptide with SEQ ID NO: 178. FIG. 21B shows the location of regions X1, X3 and X4. FIG. 21C shows the location of regions X1 and X2, as well as X3 and X4. FIG. 21D shows the location of regions X1, X2, X4 and X5.

This structure data shows that functional sequence fragments within the Cholix sequence of SEQ ID NO: 1 can have close proximity to each other such as regions X3 and X4 and regions X1 and X2.

Example 12

Cholix Derived Delivery Constructs Interact and/or Co-localize with Various Marker Proteins During Transcytosis Using Distinct Compartments This example demonstrates that Cholix derived carriers can utilize distinct compartments for trafficking into and across (e.g., via transcytosis) epithelial cells using various marker proteins (see e.g., EXAMPLE 8). These data indicates that Cholix derived carrier constructs can utilize or "hijack" specific and endogenous Cholix trafficking pathways (FIG. 24). The study described in this example was conducted using the Cholix derived delivery construct having the sequence set forth in SEQ ID NO: 149 that includes a carrier (SEQ ID NO: 135) coupled to IL-10 (SEQ ID NO: 145) via the spacer with the sequence set forth in SEQ ID NO: 176.

FIGS. 22A-22L illustrate a trafficking pathway analysis for a derived delivery construct (SEQ ID NO: 149). In FIGS. 22A-22L the white arrow #1 highlights the apical surface, white arrow #2 highlights the basal surface, and white arrow #3 highlights the lamina propria.

FIG. 22A shows that the delivery construct (SEQ ID NO: 149) strongly co-localized with the EEA1 antigen in cellular locations consistent with trafficking at both the apical and basal compartments of epithelial cells, suggesting the presence of the Cholix derived delivery construct in early endosome compartments. Red fluorescence shows localization of the EEA1 antigen, and the green fluorescence shows localization of IL-10.

FIG. 22B show that the delivery construct (SEQ ID NO: 149) strongly co-localized with the Rab7 (top left) predominantly in the apical compartment of epithelial cells, but with only limited co-localization in cells within the lamina propria, suggesting the presence of the Cholix derived delivery construct in late endosome compartments (bottom left shows white light image, and bottom right shows merged staining with DAPI staining is shown in blue, red fluorescence showing localization of the EEA1 antigen, and green fluorescence showing localization of IL-10).

FIG. 22C shows that LAMP1 was identified in large, specific vesicles consistent with mature lysosomes that were devoid of the delivery construct (SEQ ID NO: 149) (white arrows, red fluorescence showing localization of the EEA1 antigen, and green fluorescence showing localization of IL-10). The delivery construct (SEQ ID NO: 149), however, co-localized with the LAMP1 antigen in cellular locations other than lysosome-like structures, consistent with vesicle trafficking at both the apical and basal compartments of epithelial cells, suggesting the presence of the Cholix derived delivery construct in late endosomal compartments.

FIG. 22D shows that the delivery construct (SEQ ID NO: 149) construct also strongly co-localized with clathrin-coated vesicles, particularly in areas adjacent to the nucleus, and with Rab11a predominantly in the basal compartment of epithelial cells as well as in selected cells within the lamina propria. DAPI staining is shown in blue, red fluorescence shows localization of IL-10 antigen, and green fluorescence shows localization of clathrin.

FIG. 22E shows that the delivery construct (SEQ ID NO: 149) co-localized with the endoplasmic reticulum as demonstrated by calnexin (red fluorescence showing localization of calnexin, and green fluorescence showing localization of IL-10) in a pattern adjacent to the nucleus in epithelial cells and in a large fraction of cells within the lamina propria. Specifically, the delivery construct (SEQ ID NO: 149) strongly co-localized with the endoplasmic reticulum Golgi intermediate compartment (ERGIC) and the LMAN1 antigen appeared to re-distribute in response to carrier endocytosis and transcytosis, as shown for 5 (FIG. 22F), 10 (FIG. 22G), and 15 minutes after injection (FIG. 22H).

FIG. 22F shows that the delivery construct (SEQ ID NO: 149) strongly co-localized with the endoplasmic reticulum Golgi intermediate compartment 53 (ERGIC-53) and the LMAN1 antigen (red fluorescence showing localization of ERGIC-53 and LMAN1, and green fluorescence showing localization of IL-10, blue fluorescence shows DAPI staining) appeared to re-distribute in response to carrier endocytosis and transcytosis, as shown for 5 minute after injection.

FIG. 22G shows the delivery construct (SEQ ID NO: 149) construct co-localized with LMAN1 antigen 10 minutes after injection. The data show significant localization of the delivery construct (SEQ ID NO: 149) in the lamina propria.

FIG. 22H shows the delivery construct (SEQ ID NO: 149) construct co-localized with LMAN1 antigen 15 minutes after injection. The data showed significant localization of the delivery construct (SEQ ID NO: 149) in the lamina propria.

FIG. 22I shows that the delivery construct (SEQ ID NO: 149) did not co-localize with the low levels of giantin present in epithelial cells (red fluorescence showing localization of IL-10, and green fluorescence showing localization giantin, blue fluorescence shows DAPI staining). Some giantin co-localized with the construct in a subset of cells present in the lamina propria, suggesting that the Cholix derived carrier did not localize with the Golgi compartment.

FIG. 22J shows that the 58K antigen localized in epithelial cells at a site apical to the nucleus and the delivery construct (SEQ ID NO: 149) showed some co-localization (red fluorescence showing localization of IL-10, and green fluorescence showing localization 58K Golgi antigen, blue fluorescence shows DAPI staining) with this protein in a manner that suggests a brief movement through this compartment. No 58K antigen was observed in cells within the lamina propria.

FIG. 22K shows that the delivery construct (SEQ ID NO: 149, top left, IL-10 localization) showed some level of co-localization with the TGN38 antigen (top right), which showed a cellular distribution that was restricted to the apical side of nuclei in epithelial cells and adjacent to the nucleus in a few cells within the lamina propria. Bottom left image shows a white light image and bottom right shows a merge (overlay) with IL-10 (red), TGN38 (green), and DAPI signal (blue fluorescence).

FIG. 22L shows that the delivery construct (SEQ ID NO: 149) (IL-10 localization shown by green fluorescence, top right) strongly co-localized with Rab11a (top left, localization shown by red fluorescence) predominantly in the basal compartment of epithelial cells and in selected cells within the lamina propria. Bottom left image shows a white light image and bottom right shows a merge (overlay) with IL-10 (green), Rab11a (red), and DAPI signal (blue fluorescence).

FIGS. 23A-23C show microscopy images demonstrating transcytosis of an IL-10 across polarized gut epithelial cells in Wistar rats at various time points following luminal application of the delivery construct with the sequence set forth in SEQ ID NO: 149 to rat jejunum. The delivery construct (SEQ ID NO: 149) included a carrier with SEQ ID NO: 135 coupled to an IL-10 payload having the amino acid set forth in SEQ ID NO: 145 via a spacer having an amino acid sequence set forth in SEQ ID NO: 176. Green fluorescence indicates the presence of IL-10 (via staining with an anti-IL-10 antibody). Blue fluorescence indicates DAPI staining, which labels DNA, and red fluorescence indicates the presence of CK-8 (cytokeratin-8) with which a Cholix-derived carrier can co-localize (e.g., in a supranuclear region of an epithelial cell) during transcytosis. The white arrows #1 highlight the apical membrane of the epithelial cells, and the white arrows #2 highlight the basal membrane of the epithelial cells.

FIG. 23A demonstrates the extent of transcytosis of IL-10 one minute after luminal application of the delivery construct with the sequence set forth in SEQ ID NO: 149 to rat jejunum. The data showed that transport of an IL-10 payload from the apical to the basal site and into the lamina propria occurred as early as 1 minute after application of the delivery construct. White arrow #3 indicates the presence of IL-10 in the lamina propria.

FIG. 23B demonstrates the extent of transcytosis of IL-10 five minutes after luminal application of the delivery construct with the sequence set forth in SEQ ID NO: 149 to rat jejunum. The data showed an increased amount of transported IL-10 payload that was present in the lamina propria (see e.g., white arrows #3) 5 minutes after luminal application of the delivery construct.

FIG. 23C demonstrates the extent of transcytosis of IL-10 ten minutes after luminal application of the delivery construct with the sequence set forth in SEQ ID NO: 149 to rat jejunum. The data showed an even higher amount of transported IL-10 payload that was present in the lamina propria (see e.g., white arrows #3) 10 minutes after luminal application of the delivery construct.

Additional trafficking experiments utilizing fluorescence microscopy have been conducted to shed light on the transcytosis mechanism of the Cholix carrier with SEQ ID NO: 135 that is included in the delivery construct with SEQ ID NO: 149.

FIGS. 23D-23F show apical endocytosis and early trafficking of the Cholix carrier with SEQ ID NO: 135 in epithelial cells 1 min after luminal injection of the delivery construct (SEQ ID NO: 149) comprising the Cholix carrier with SEQ ID NO: 135 coupled to an IL-10 (SEQ ID NO: 145) in rat jejunum. The data showed that Cholix-derived carriers avoid the lysosomal destruction pathway by interacting with lysosome avoidance receptors. Cholix carrier localization is shown by green fluorescence, apical entry receptor (e.g., TMEM132) localization is shown by red fluorescence; and localization of lysosome avoidance receptors is shown by purple fluorescence; thus interaction of Cholix carrier and apical entry receptor is shown by yellow fluorescence, interaction of Cholix carrier and lysosome avoidance receptor is shown by pink fluorescence, and interaction and/or co-localization of Cholix carrier, apical entry receptor, and lysosome avoidance receptor is shown by white spots (overlay of green, red, and purple fluorescence). DAPI staining is indicated by blue fluorescence.

FIG. 23D shows localization of the Cholix carrier (SEQ ID NO: 135) at the apical membrane (indicated by white arrow #1) of a polarized epithelial cell. Basal membrane is indicated by white arrow #2 and the lamina propria is indicated by white arrow #3.

FIG. 23E shows interaction of Cholix carrier (SEQ ID NO: 135) with apical entry receptor (e.g., TMEM132) as indicated by yellow fluorescence at and around the apical membrane.

FIG. 23F shows that Cholix carrier (SEQ ID NO: 135), apical entry receptor, and lysosome avoidance receptor are in close proximity at the apical membrane as shown by white spots (e.g., overlay of green, red, and purple fluorescence) indicated by the white arrow. It is assumed that the lysosome avoidance receptor can approach a Cholix carrier-apical entry receptor complex, followed by dissociation of the Cholix carrier with the apical entry receptor and association of the Cholix carrier with lysosome avoidance receptor due to changes in the pH environment and the pH-dependency of these Cholix carrier-receptor interaction as shown, e.g., in FIG. 15B.

FIGS. 23G-23H show trafficking of a Choli carrier (SEQ ID NO: 135) from apical to supranuclear compartments in epithelial cells 5 and 15 min after luminal injection of the delivery construct (SEQ ID NO: 149) comprising a Cholix-derived carrier (SEQ ID NO: 135) coupled to an IL-10 (SEQ ID NO: 145) in rat jejunum. Cholix carrier localization is shown by green fluorescence, ERGIC receptor localization is shown by red fluorescence, apical entry receptor (e.g., TMEM132) localization is shown by orange fluorescence; and localization of lysosome avoidance receptors is shown by purple fluorescence; thus interaction of Cholix carrier and ERGIC receptor is shown by yellow fluorescence, interaction of Cholix carrier and lysosome avoidance receptor is shown by pink fluorescence, and interaction and/or co-localization of Cholix carrier, apical entry receptor, and lysosome avoidance receptor is shown by white spots (overlay of green, red, and purple fluorescence). DAPI staining is indicated by blue fluorescence.

FIG. 23G shows localization of the Cholix carrier (SEQ ID NO: 135) in a polarized gut epithelial cell 5 minutes after luminal injection of the delivery construct (SEQ ID NO: 149). The data showed that, following apical receptor-mediated endocytosis, the Cholix carrier formed complexes with a lysosome avoidance receptor and apical entry receptor close to the apical membrane (indicated by white spots (overlay of green, red, and purple fluorescence) and highlighted by white arrow) and also started interacting with ERGIC receptor as demonstrated by yellow fluorescence (and the yellow arrow) slightly closer to supranuclear regions within the cell.

FIG. 23H shows localization of the Cholix carrier (SEQ ID NO: 135) in a polarized gut epithelial cell 15 minutes after luminal injection of the delivery construct (SEQ ID NO: 149). The data showed that the carrier moved from apical to supranuclear compartments while associated with ERGIC (see yellow arrow), wherein the yellow fluorescence intensity is increased compared to 5 minutes post-injection, indicating increased Cholix carrier movement from apical to supranuclear regions over time. The data further showed localization of Cholix carrier at the basal membrane and in the lamina propria (gold arrows).

Together, these data demonstrated that Cholix derived carriers can utilize endogenous Cholix trafficking pathways to transcytose across polarized epithelial cells and thus can be used to rapidly and efficiently transport payload (e.g., therapeutic proteins such as interleukins) across epithelial cell barriers without impairing the biological activity of such payload.

Example 13

Transport of Anti-TNFα Agents Across Epithelial Cell Layers

This example shows the Cholix polypeptide derived carrier can transport anti-TNFα agents across intact epithelial cell layers.

The delivery constructs are tested for intestinal epithelial transport as follows: wild-type rats (Sprague Dawley®, ~200-250 grams, ~6 weeks old, purchased from Charles River) are fasted overnight to clear intestines; prepare microfuge tubes containing 4% formaldehyde, tubes for tissue preservation, microfuge tubes for blood collection, microfuge tubes for serum collection, PBS, and test article; animals are prepped for experiment (anesthetize animals with Isoflurane, and shave abdomen); prepare injections for each animal (each animal receives 4 injections (2× jejunum and 2× colon); opened the abdominal cavity, located and marked sites of injection with distinguishing colors; slowly inject test article into lumen (injection occurs at 10 minutes in colon and 40 minutes in jejunum) and animals receive 35 µg of protein per injection at concentration of 1 µg/µL; animals are euthanized at 50 minutes; terminal blood is collected via cardiac puncture; remove jejunum and colon and placed on plastic-lined work surface; flush contents of jejunum and colon using PBS and discarded; excise 1 cm length of intestine from injection site; cut the excised tissue in half, and place 1 section into 4% formaldehyde. The remaining tissue is then sliced lengthwise and immediately placed in microfuge tube and frozen. This process can be repeated for all injection sites. Remove liver (~1 cm$^3$) and divide into 2 pieces. Place 1 section of liver in formaldehyde and the second for immediate frozen storage. Intestinal, liver & blood serum samples are collected at 40 min termination. Centrifuge blood samples and transfer serum to container for storage. Samples are transported on dry-ice and stored at −80° C. The dosing strategy was as follows: Chx$^{386}$-anti-TNFα 100 µL, 490 pmol/98 µg (4.9 uM); Chx$^{415}$-anti-TNFα 100 µL, 490 pmol/99.5 µg (4.9 uM); anti-TNFα 100 µL, 490 pmol/76 µg (4.9 uM).

Bioanalytical analysis of the intestinal epithelial transport of the Cholix-anti-TNF-α constructs are performed using a mouse IgG1 ELISA kit (Abcam®, Cat # ab133045) as follows: tissue samples are obtained from Brains On-line; 300 µL assay buffer 1X is added to each tube containing tissue sample; tissue is removed from the assay buffer and placed on sterile, clean cell culture lid plate; intestinal samples are gently scrapped with a cell scrapper being careful to avoid collection of the mesentery; liver samples are treated in a similar manner with additional maceration and homogenization; the resulting cellular homogenate is transferred back into the original tube; remaining tissue samples and the work area are rinsed with 100 µL buffer (2×); cellular homogenate solution is centrifuged at maximum force for 5 minutes; supernatant is applied to ELISA plate according to the manufacturer's instructions. Remaining supernatant is stored at −20° C. for later use.

FIG. 25 shows that both a Cholix$^{386}$ derived carrier (e.g., SEQ ID NOs: 135 or 180) and a Cholix$^{415}$ derived carrier (e.g., comprising residues 1-415 of SEQ ID NO: 1) transport an anti-TNFα agent (e.g., an anti-TNFα antibody or functional fragment thereof) across intestinal epithelial cells at 10 minutes and at 40 minutes. Moreover, a Cholix$^{386}$-anti-TNFα construct transports at about 12× the rate of anti-TNF-α alone and a Cholix$^{415}$-anti-TNFα transports at ~7× the rate of anti-TNF-α alone.

These data demonstrate that Cholix derived carriers are capable of transporting a variety of payload molecules such as anti-TNFα agent across intact and polarized epithelial cell layers.

Example 14

Preparation of Delivery Constructs Comprising Exenatide

Exenatide (SEQ ID NO: 195) is a peptide having GLP-1-like biological activity that is stabilized by a C-terminal amine and an N-terminal H. In this Example, two non-naturally occurring isolated constructs comprising: 1) a carrier having SEQ ID NO: 194 processed to a carrier having SEQ ID NO: 192 and crosslinked to SEQ ID NO: 195 and 2) a carrier having SEQ ID NO: 193 processed to a carrier having SEQ ID NO: 191 and crosslinked to SEQ ID NO: 195 were prepared and tested for intestinal epithelial transport in vivo. Carriers having SEQ ID NO: 191 and SEQ ID NO: 192 were prepared as described herein and Exenatide (SEQ ID NO: 195) (Cat # HOR-246) was purchased from ProSpec-Tany Technogene Ltd. PO Box 6591, East Brunswick, N.J. 08816. A Pierce™ Controlled Protein-Protein Crosslinking Kit (Cat #23456) comprising the Sulfo-SMCC Crosslinking Agent was purchased from ThermoFisher.

Payload and Carrier Activation and Crosslinking:

Exenatide (10 mg) was dissolved in 5 mL H$_2$O to form a 2 mg/mL solution. Sulfo-SMCC (2 mg) was dissolved in 2 mL of PBS. Immediately thereafter, 0.088 mL (~5-fold molar excess) of the Sulfo-SMCC solution was added to 1.0 mL Exenatide solution and incubated for 30 minutes at room temperature. Nonreacted Sulfo-SMCC was removed by applying 1.0 mL of the maleimide-Exenatide reaction mixture to a desalting column equilibrated with PBS, eluting with PBS, and collecting 0.5 mL fractions. The absorbance at 280 nm of each fraction was measured to locate the protein peak. Peak fractions containing most of the protein were pooled. The concentration of the pooled activated Exenatide was determined by comparing its absorbance at 280 nm with the absorbance of the original protein solution.

Carriers having SEQ ID NO: 193 and SEQ ID NO: 194 have a C-terminal extension comprising a TEV cleavage site flanked by two cysteine residues that form a disulfide bond and a C-terminal His$_6$ tag (SEQ ID NO: 205). Carriers having SEQ ID NO: 193 and SEQ ID NO: 194 were purified on a HisTrap column using standard methods. 2 mg protein (200 µL of 10 mg/ml) in PBS at pH 7.4 was activated by treatment with 2 µl of 0.1M dithiothreitol and 5 µl of TEV protease for two hours at 30° C. Cleaved and reduced protein was applied to a 1-ml HisTrap column equilibrated with PBS. The C-terminal fragment bound to the column and the activated N-terminal SEQ ID NO: 191 or SEQ ID NO: 192 product with a free cysteine near its C-terminus was collected in the flow through.

The maleimide-activated Exenatide and carriers (sulfhydryl-SEQ ID NO: 191 protein or sulfhydryl-SEQ ID NO: 192 protein) were mixed in equal molar amounts and then incubated for 60 minutes at room temperature. The purity of the SMCC-crosslinked SEQ ID NO: 192—Exenatide complex was assessed on a COOMASSIE-stained SDS gel. The complex was approximately the correct molecular weight and had >90% purity (FIG. 26). The crosslinked delivery construct was then stored at 4° C.

Example 15

In Vivo Transcytosis of Exenatide Delivery Constructs

The delivery constructs were tested for intestinal epithelial transport as follows: wild-type Sprague Dawley® rats (~200-250 grams, ~6 weeks old, purchased from Charles River) were fasted overnight to clear their intestines. The following materials were prepared: microfuge tubes containing 4% formaldehyde, tubes for tissue preservation, microfuge tubes for blood collection, microfuge tubes for serum collection, PBS, and test article. Animals were prepped for the experiment by anesthetizing them with Isoflorane and shave their abdomens. Four injections were prepared for each animal (2 per jejunum and 2 per colon). The abdominal cavity was opened. Injection sites were located and marked with distinguishing colors. Test articles were slowly injected into the lumen over 10 minutes for the colon and 40 minutes for the jejunum. Animals received 35 µg of protein per injection at concentration of 1 µg/µL. Animals were euthanized at 50 minutes. Terminal blood was collected via cardiac puncture. The jejunum and colon were removed and placed on a plastic-lined work surface. The contents of the jejunum and colon were flushed using PBS and discarded. A 1 cm length of intestine was excised from the injection site. The excised tissue was cut in half. One section was placed into 4% formaldehyde. The remaining tissue was then sliced lengthwise and immediately placed in a microfuge tube and frozen. This process was repeated for all injection sites. The liver (~1 $cm^3$) was removed and divided into 2 pieces. For storage, one section of liver was placed in formaldehyde and a second was immediately frozen. Intestinal, liver & blood serum samples were collected at 40 min after injection. Blood samples were centrifuged and the resulting serum was transferred to a container for storage. Samples were transported on dry ice and stored at −80° C. The dosing strategy was as follows: SEQ ID NO: 192-Exenatide 100 µL, 490 pmol/29.4 µg (4.9 µM); SEQ ID NO: 191-Exenatide 100 µL, 490 pmol/30.9 µg (4.9 µM); SEQ ID NO: 195, 100 µL, 490 pmol/2 µg (4.9 µM).

Bioanalytical analysis of the intestinal epithelial transport of SEQ ID NO: 192-Exenatide, SEQ ID NO: 191-Exenatide, and SEQ ID NO: 195 (Exenatide) was performed using an Exendin-4 ELISA kit (Phoenix Pharma, Cat # EK-070-94) as follows: tissue samples were obtained from Brains Online; 300 µL assay buffer (1×) was added to each tube containing a tissue sample; tissue was removed from the assay buffer and placed on a sterile, clean cell culture lid plate; intestinal samples were gently scrapped with a cell scrapper, being careful to avoid collection of the mesentery; liver samples were treated in a similar manner with additional maceration and homogenization; the resulting cellular homogenate was transferred back into the original tube; remaining tissue samples and the work area were rinsed with 100 µL buffer (2×); cellular homogenate solution was centrifuged at maximum force for 5 minutes; supernatant was applied to an ELISA plate, which was processed according to the manufacturer's instructions; remaining supernatant was stored at −20° C. for later use.

As depicted in FIG. 27, transport of both SEQ ID NO: 192-Exenatide and SEQ ID NO: 191-Exenatide across intestinal epithelial cells was observed at 10 minutes and at 40 minutes. Moreover, both SEQ ID NO: 192-Exenatide and SEQ ID NO: 191-Exenatide were transported at a higher rate than SEQ ID NO: 195 (Exenatide) alone, especially at 40 minutes.

Example 16

Spacer Length and Coupling of Payload to the N- or C-Terminus of a Carrier does not Significantly Affect a Payload's Biological Activity This example shows that amino acid linkers of various lengths and the coupling of a heterologous payload to the N-terminus of a carrier does not significantly impact the payloads ability to bind its target when included into a delivery construct.

The IL-22 receptor dimerization assay was performed by seeding DiscoverX HEK293 cells and incubate the cells for 16 h (5,000 cells per well) using the shown concentrations of agonist (delivery construct containing the IL-22 payload). The endpoint luminescence was read on a on plate reader using PathHunter® eXpress IL22RA1/IL10RB Dimerization Assay.

FIG. 28A shows that the length of amino acid spacers with SEQ ID NOs: 175, 196, and 197 did not impact the ability of IL-22 (SEQ ID NO: 142) when included in the delivery constructs with SEQ ID NOs: 147, 198, and 199 to induce IL-22 receptor dimerization. The induction of receptor dimerization of control recombinant human IL-22 (rhIL-22, SEQ ID NO: 143) is shown by the black curve.

FIG. 28B shows that coupling of the IL-22 payload (SEQ ID NO: 142) to the N- or to the C-terminus of a carrier comprising amino acid residues 1-266 of SEQ ID NO: 1 via the spacer with SEQ ID NO: 196 did not significantly change the ability of the delivery constructs with SEQ ID NOs: 198, 200, and 201 to induce IL-22 receptor dimerization. The induction of receptor dimerization of control recombinant human IL-22 (rhIL-22) is shown by the black curve.

The pSTAT3 activation assay was conducted using Colo205 cells incubated with 10 nt of agonist (the respective delivery construct or IL-22 control) having the various concentrations for 15 min. The extend of pSTAT3 activation was then read using MSD STAT3 plates (Cat. No. N450SMA-1).

FIG. 28C shows that the length of amino acid spacers with SEQ ID NOs: 175, 196, and 197 did not impact the ability of IL-22 (SEQ ID NO: 142) when included in the delivery constructs with SEQ ID NOs: 147, 198, and 199 to induce pSTAT3 activation. The pSTAT3 activation of control recombinant human IL-22 (rhIL-22, SEQ ID NO: 143) is shown by the black curve.

FIG. 28D shows that coupling of the IL-22 payload (SEQ ID NO: 142) to the N- or to the C-terminus of a carrier comprising amino acid residues 1-266 of SEQ ID NO: 1 via the spacer with SEQ ID NO: 196 did not significantly change the ability of the delivery constructs with SEQ ID NOs: 198, 200, and 201 to induce pSTAT3 activation. The pSTAT3 activation of control recombinant human IL-22 (rhIL-22) is shown by the black curve.

All of the articles and methods disclosed and claimed herein can be made and executed without undue experimentation in light of the present disclosure. While the articles and methods of this disclosure have been described in terms of embodiments, it will be apparent to those of skill in the art that variations can be applied to the articles and methods without departing from the spirit and scope of the disclosure. All such variations and equivalents apparent to those skilled in the art, whether now existing or later developed, are deemed to be within the spirit and scope of the disclosure as defined by the appended claims. All patents, patent applications, and publications mentioned in the specification are indicative of the levels of those of ordinary skill in the art to which the disclosure pertains. All patents, patent applications, and publications are herein incorporated by reference in their entirety for all purposes and to the same extent as if each individual publication was specifically and individually indicated to be incorporated by reference in its entirety for any and all purposes. The disclosure illustratively described herein suitably can be practiced in the absence of any element(s) not specifically disclosed herein. The terms and expressions which have been employed are used as terms of description and not of limitation, and there is no intention that in the use of such terms and expressions of excluding any equivalents of the features shown and described or portions thereof, but it is recognized that various modifications are possible within the scope of the disclosure claimed. Thus, it should be understood that although the present disclosure has been specifically disclosed by embodiments and optional features, modification and variation of the concepts herein disclosed can be resorted to by those skilled in the art, and that such modifications and variations are considered to be within the scope of this disclosure as defined by the appended claims.

SEQUENCE LISTING (205 sequences)

SEQ ID NO: 1 - protein, 634 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 2 - protein, 634 aa, Artificial Sequence
  Description of Artificial Sequence: Synthetic polypeptide
LEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 3 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 4 - protein, 644 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 5 - protein, 639 aa, Vibrio cholerae
VEDELNIFDECRSPCSLTPEPGKPIQSKLSIPSDVVLDEGVLYYSMTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 6 - protein, 639 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYERLTPAEEAVVKEAIAKEQSISAKPPYKEQKDELK

SEQ ID NO: 7 - protein, 639 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYERLTPAEEAVVKEAIAKEQSISAKPPYKEQKDELK

SEQ ID NO: 8 - protein, 634 aa, Vibrio cholerae
VEDELNIFDECRSPCSLTPEPGKQIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCVYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEKKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 9 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 10 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVSTHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 11 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCVYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEKKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 12 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIHRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 13 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 14 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLIPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 15 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLIPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 16 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRMLFSHLDSVFTLNLDEQEPEVAERLSALRQINENNPGMVTQVLTVARQIYNDYVTHHPGLIPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 17 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARLKKGTGNAELPTRAERDARGVMLRVYIPRASLERFYRTNTPLENAEEHITHVIGHSLPLRNEAFTGPERVDGEDETVIGWDMAIHAVAIPSTIPGNAYEVLAIDEEAVAEEQSISAKPPYKERKDELK

SEQ ID NO: 18 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVFFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVTERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIHRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 19 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 20 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVALNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 21 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQAPEVAERLSALRQINENNPGVVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 22 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITDVIGHSLPLRNEAFTGPESAGGEDETVIGWDMAIHAVAIPSTIPGNAYEELAIDEEAVAKEQSISAKPPYKEQKDELK

SEQ ID NO: 23 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAIMVKQGIEQKPVEQRIHFSKKNAMEALAAHRVCGVPLETLARSRKPRYLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISPKPPYKERKDELK

SEQ ID NO: 24 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKDGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSAIRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 25 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKDGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKHCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 26 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWRTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 27 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSNGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 28 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLLENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 29 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQKNCTLGDNWFGGSYETVAGTPKVITVKQGIEQKPVEQRIHFSKGNAMSALAAHRVCGVPLETLARSRKPRDLPDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 30 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIYAVAIPSTIPGNAYEELAIDEEAVAKEQSISAKPPYKEQKDELK

SEQ ID NO: 31 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 32 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIYAVAIPSTIPGNAYEELAIDEEAVAKEQSISAKPPYKEQKDELK

SEQ ID NO: 33 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPMDAIYNYITQKNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 34 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISTKPPYKERKDELK

SEQ ID NO: 35 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITDVIGHSLPLRNEAFTGPESAGGEDETVIGWDMAIHAVAIPSTIPGNAYEELAIDEEAVAKEQSISAKPPYKEQKDELK

SEQ ID NO: 36 - protein, 634 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAIHWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 37 - protein, 634 aa, Vibrio cholerae
VEDELNIFDECRSPCSLTPEPGKPIQSKLSIPSDVVLDEGVLYYSMTINDEQNDIKDEDKGESIITIGEFATIRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 38 - protein, 634 aa, Vibrio cholerae
VEDELNIFDECRSPCSLTPEPGKPIQSKLSIPSDVVLDEGVLYYSMTINDEQNDIKDEDKGESIITFGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 39 - protein, 634 aa, Vibrio cholerae
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 40 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 41 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 42 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQNIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 43 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDIAIHAVAIPSTIPGNAYEELAIDEEAVAKEQSISTKPPYKERKDELK

SEQ ID NO: 44 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 45 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMETLAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 46 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 47 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMETLAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 48 - protein, 634 aa, Vibrio cholerae
VEDELNIFDECRSPCLLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKEQKDELK

SEQ ID NO: 49 - protein, 634 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVIPGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMETLAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPSTIPGNAYEELAIDEEAVAKEQSISAKPPYKERKDELK

SEQ ID NO: 50 - protein, 633 aa, Vibrio cholerae
VEDELNIFDECRSPCSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKERKDELK

SEQ ID NO: 51 - protein, 633 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSQKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 52 - protein, 633 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKERKDELK

SEQ ID NO: 53 - protein, 633 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 54 - protein, 633 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 55 - protein, 633 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGIPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKERKDELK

SEQ ID NO: 56 - protein, 633 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGIPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 57 - protein, 633 aa, Vibrio cholerae
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 58 - protein, 633 aa, Vibrio cholerae
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAQKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGGVYVATHAELAHRYARIKEGTGENGLPTTEEKKSRGVMLRVYLPRASLERFYRTNIPLENADEHVTQVIGHPLPLRNEAFTGPESAGGEDETAIGWDMAIHGVAIPSTIPGNSYAQLPIDEEAVAKEQSISAKPPYKEHDELK

SEQ ID NO: 59 - protein, 633 aa, Vibrio cholerae
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAQKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGGVYVATHAEVNHRYARIKEGTGENGLPTTEEKKSRGVMLRVYLPRASLERFYRTNIPLENADEHVTQVIGHPLPLRNEAFTGPESAGGEDETAIGWDMAIHGVAIPSTIPGNSYAQLPIDEEAVAKEQSISAKPPYKEHDELK

SEQ ID NO: 60 - protein, 633 aa, Vibrio cholerae
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAQKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGGVYVATHAELAHRYARIKEGTGENGLPTTEKKKSRGVMLKVYLPRASLERFYRTNIPLENADEHVTQVIGHPLPLRNEAFTGPESAGGENETAIGWDMAIHGVAIPSTIPGNSYAQLPIDEEAVAKEQSISAKPPYKEHDELK

SEQ ID NO: 61 - protein, 633 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKEQKDELK

SEQ ID NO: 62 - protein, 633 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVIPGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPSTIPGNAYEGLTTDEEAVVKEAIAKEQSISAKPPYKERKDELK

SEQ ID NO: 63 - protein, 633 aa, Vibrio cholerae
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVIPGEDSPASIKISIDELDQQRNIIEVPKLYSIDLDNQTLEQWETQGNVSFAVTRPEQSIAISWPSVSYKAAQKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGGVYVATHAELAHRYARIKEGTGENGLPTTEEKKSRGVMLRVYLPRASLERFYRTNIPLENADEHVTQVIGHPLPLRNEAFTGPESAGGEDETAIGWDMAIHGVAIPSTIPGNSYAQLPIDEEAVAKEQSISAKPPYKEHDELK

SEQ ID NO: 64 - protein, 628 aa, Vibrio cholerae
VEDELNIFDECRSPCSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 65 - protein, 628 aa, Vibrio cholerae
VEDELNIFDECRSPCSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 66 - protein, 628 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEQSIAISWPSVSYNAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 67 - protein, 628 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 68 - protein, 628 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISTKPPYKERKDELK

SEQ ID NO: 69 - protein, 628 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVINLDITTENGTKMYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISTKPPYKERKDELK

SEQ ID NO: 70 - protein, 628 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQKRNIIEVPKLYSIDLDNQTLEQWENQGNVSFAVTRPEQSIAISWPSVSYKAAHKNGSRHKRWANWLTTLPKVVLCFYEEPELCTYGEDWHGGAYKTVAGTPEAITVKQGIEQKTVEQRIHFSKKNAMEALAAHRVCGVPLETLARSRKPRDLQDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 71 - protein, 628 aa, Vibrio cholerae
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 72 - protein, 628 aa, Vibrio cholerae
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPLLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 73 - protein, 628 aa, Vibrio cholerae
VEDELNIFDECRSPCSLTPEPGKPIQSKLSIPGDVVLDEGVLYYSMTINDEQNDIKDEDKGESIITIGEFATVRATRHYVNQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 74 - protein, 628 aa, Vibrio cholerae
VEDELNIFDECRSPCSLTPEPGKPIQSKLFIPGDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAIEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 75 - protein, 628 aa, Vibrio cholerae
VEDELNIFDECRSPCSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWYGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDTDKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 76 - protein, 628 aa, Vibrio cholerae
VEDELKIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 77 - protein, 628 aa, Vibrio cholerae
VEDELKIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQAPEVAERLSDLRRINEDNPGMVTQVLTVARQIYNDYVTHHPGLTPEQTSAGAQAADILSLFCPDADKSCVASNNDQANINIESRSGRSYLPENRAVITPQGVTNWTYQELETTHQALTREGYVFVGYHGTNHVAAQTIVNRIAPVPRGNNTENEEKWGGLYVATHAEVAHGYARIKEGTGEYGLPTRAERETRGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKEQKDELK

SEQ ID NO: 78 - protein, 628 aa, Vibrio cholerae
VEDELKIFDECRSPCSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKAVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIYAVAIPSTIPGNAYEELAIDEEAVAKEQSISAKPPYKEQKDELK

SEQ ID NO: 79 - protein, 617 aa, Vibrio cholerae
TPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPSTIPGNSYAQLPIDEEAVAKEQSISAKPPYKEQKDELK

SEQ ID NO: 80 - protein, 605 aa, Vibrio cholerae
SIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 81 - protein, 594 aa, Vibrio cholerae
MTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 82 - protein, 588 aa, Vibrio cholerae
CSLTPEPGKPIQSKLSIPSDVVLDEGVLYYSMTINDEQNDIMDEGKGESIITIGEFATVRATRHYVNQDAPFGVINLDITTENGTKTYSYNRKEGEFTINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETIIGWDMAIHAVAIPS

SEQ ID NO: 83 - protein, 588 aa, Vibrio cholerae
CSLTPEPGKPIQSKLSIPSDVVLDEGVLYYSMTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPMDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 84 - protein, 588 aa, Vibrio cholerae
CSLTPEPGKPIQSKLSIPSDVVLDEGVLYYSMTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 85 - protein, 583 aa, Vibrio cholerae
MTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKAVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIYAVAIPSTIPGNAYEELAIDEEAVAKEQSISAKPPYKEQKDELK

SEQ ID NO: 86 - protein, 583 aa, Vibrio cholerae
MTINDEQNDIKDEDKGESIITIGDFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPSTIPGNAYEELAIDEEAVAKEQSISTKPPYKERKDELK

SEQ ID NO: 87 - protein, 583 aa, Vibrio cholerae
CSLTPEPGKPIQSQLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERAGGEDETVIGWDMAIHAVAIPS

SEQ ID NO: 88 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 89 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 90 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLIPEQTSAGAQAADILSLFCPDADKPCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPS

SEQ ID NO: 91 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKTVEQRIHFSKKNAMEALAAHRVCGVPLETLARSRKPRDLTDDLSCVYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITDVIGHSLPLRNEAFTGPESAGGEDETVIGWDMAIHAVAIPS

SEQ ID NO: 92 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVALNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 93 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAIMVKQGIEQKPVEQRIHFSKKNAMEALAAHRVCGVPLETLARSRKPRYLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPS

SEQ ID NO: 94 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKDGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSAIRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 95 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKDGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYLTNTPLENAEEHITQVIGHSLPLRNEAFTGPESAGGEDETVIGWDMAIHAVAIPS

SEQ ID NO: 96 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 97 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYTRIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 98 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFYPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 99 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIHAVAIPS

SEQ ID NO: 100 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPMDAIYNYITQKNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 101 - protein, 583 aa, Vibrio cholerae
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 102 - protein, 583 aa, Vibrio cholerae
CSLTPELGKPIQSKLSISSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAERHITQVIGHSLPLRNEAFTGPESAGGEDETVIGWDMAIHAVAIPS

SEQ ID NO: 103 - protein, 583 aa, Vibrio cholerae
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 104 - protein, 583 aa, Vibrio cholerae
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLEEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 105 - protein, 583 aa, Vibrio cholerae
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASDNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 106 - protein, 583 aa, Vibrio cholerae
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINVESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAEREARGVMLRVYIPRASLERFYRTNTPLENAERHITQVIGHSLPLRNEAFTGPESAGGEDETVIGWDMAIHAVAIPS

SEQ ID NO: 107 - protein, 583 aa, Vibrio cholerae
CSLTPELGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPERVDGEDETVIGWDMAIHAVAIPS

SEQ ID NO: 108 - protein, 583 aa, Vibrio cholerae
CSLTPELGKPIQSKLSIPSDVVLDEGVLYYSMTINDDQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKPCVASNNDQANINIESRSGRSYLPENRAVITPQGVTNWTYQELEATHQALTREGYVFVGYHGTNHVAAQNIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 109 - protein, 582 aa, Vibrio cholerae
CSLTPEPGKPIQSKLSIPSDVVLDEGVLYYSMTINDEQNDIMDEGKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAKQSIAISWPSVSYKAAHKNGSRHKRWANWLTTLPKVVLCFFEDPELCTYGEDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTLLENAEEHITQVIGHSLPLRNEAFTGPESAGGEDETVIGWDMAIHAVAIPS

SEQ ID NO: 110 - protein, 577 aa, Vibrio cholerae
CSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 111 - protein, 577 aa, Vibrio cholerae
CSLTPEPGKPIQSKLSIPSDVVLDEGVLYYSMTINDEQNDIKDEDKGESIITIGEFATVRATRHYVSQDAPFGVINLDITTENGTKTYSFNRKESEFAINWLVPIGEDSPASIKISVDELDQQRNIIEVPKLYSIDLDNQTLEQWETQGNVSFAVTRPEQSIAISWPSVSYKAAHKNGSRHKRWANWFTTSPKVTLCFYEDPAQCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHAAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPS

SEQ ID NO: 112 - protein, 577 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 113 - protein, 577 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQAPEVAERLSDLRRINEDNPGMVTQVLTVARQIYNDYVTHHPGLTPEQTSAGAQAADILSLFCPDADKSCVASNNDQANINIESRSGRSYLPENRAVITPQGVTNWTYQELETTHQALTREGYVFVGYHGTNHVAAQTIVNRIAPVPRGNNTENEEKWGGLYVATHAEVAHGYARIKEGTGEYGLPTRAERETRGVMLRVYIPRASLERFYRTNTPLENAEEHITQVIGHSLPLRNEAFTGPESAGGEDETVIGWDMAIHAVAIPS

SEQ ID NO: 114 - protein, 577 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGNGGLPTRAERETRGVMLRVYIPRASLERFYRTNTPLENAEEHITQVIGHSLPLRNEAFTGPESAGGEDETVIGWDMAIYAVAIPS

SEQ ID NO: 115 - protein, 577 aa, Vibrio cholerae
CSLTPEPGKPIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDEIDQQRNIIEVPKLYSIDLDNQTLEQWENQGNVSFAVTRPEQSIAISWPSVSYKAAHKNGSRHKRWANWFTTSPKVTLCFYEDPAQCTYGDDWHGGAYKTVAGIPKAITVKQGIEQKTVEQRIHFSKKNAMEALAAHRVCGVPLETLARSRKPRDLPDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREDYVFVGYHGTNHVAAQTIVNRIAPVPRGNNTENEEKWGGLYVATHAEVAHGYARIKEGTGEYGLPTRAEQETRGVMLRVYIPRASLERFYRTNTPLENAEEHITQVIGHSLPLRNEAFTGPESAGGEDETVIGWDMAIHAVAIPS

SEQ ID NO: 116 - protein, 577 aa, Vibrio cholerae
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEEPELCTYGEDWHGGAYKTVAGTPGAITVKQGIEQKTVEQRIHFSKGNAMSALAAHRVCGVPLETLARSRKPRDLTDDLSCAYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 117 - protein, 577 aa, Vibrio cholerae
CSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQKRNIIEVPKLYSIDLDNQTLEQWENQGNVSFAVTRPEQSIAISWPSVSYKAAHKNGSRHKRWANWLTTLPKVVLCFYEEPELCTYGEDWHGGAYKTVAGTPEAITVKQGIEQKTVEQRIHFSKKNAMEALAAHRVCGVPLETLARSRKPRDLPDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPS

SEQ ID NO: 118 - protein, 577 aa, Vibrio cholerae
CSLTPEPGKPIQSKLSIPSDVVLDEGVLYYSMTINDEQNDIKDEDKGESIIIIGEFATVRATRHYVNQDAPFGVINLDITTENGTKTYSYNRKEGEFAINWLVPIGEDSPASIKISVDELDQQRNIIEVPKLYSIDLDNQTLEQWENQGNVSFAVTRPEQSIAISWPSVSYKAAHKNGSRHKRWANWLTTLPKVVLCFYEDPELCTYGDDWHGGAYKTVAGTPKAITVKQGIEQKTVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRVVITPQGVTNWTYQELDATHQALTREDYVFVGYHGTNHVAAQTIVNRIAPVPRGNNTENEEKWGGLYVATHAEVAHGYARIKEGTGEYGLPTRAERETRGVMLRVYIPRASLERFYRTNTPLENAEEHITQVIGHSLPLRNEAFTGPESAGGEDETVIGWDMAIHAVAIPS

SEQ ID NO: 119 - protein, 577 aa, Vibrio cholerae
CSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPS

SEQ ID NO: 120 - protein, 577 aa, Vibrio cholerae
CSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWENQGNVSFAVTRPEQSIAISWPSVSYKAAHKNGSRHKRWANWLTTLPEVVLCFFEDPELCTYGDDWHGGAYKTVAGTPKAITVKQGIEQKTVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSASAQAADILSLFCPDADKSCVASNSDQANINIESRSGRSYLPENRAVITQQGVTNWTYQELEATHQALTQEGYVFVGYHGTNHVAAQSIVNRISPVPRGSDTESERAWGGLYVSTDASVAYGYARIQEGTADGGGLTPAERKARGVMLRVYLPQASLERFYRINADLEKERNLVERVIGHPLPLRNEAFTGTDAEEGSDETAIGWDMAIHGVAIPS

SEQ ID NO: 121 - protein, 531 aa, Vibrio cholerae
VEDELNIFDECRSPCSLTPEPGKQIQSKLSIPSDVVLDEGVLYYSMTINDEQNDIKDEDKGESIITIGEFATVRATRHYVNQDAPFGVINLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLTDDLSCVYQAQNIVSLFVATRILFSHLDSVFTLNLDEQEPEVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEKKWGGLYVATHAEVAHGYARIKEGTGEYGLPTRAERDARGVMLRV

SEQ ID NO: 122 - protein, 491 aa, Vibrio cholerae
VEDELNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAEKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLLCPDADGSCVASNSDQANINIESRSGRSYLPENRAVITPQGVTNWTYQELEAKHQTLTREGYVFVGYHGTNHVAAQSIVNRITPVPRGNNTEKEEEWGG

SEQ ID NO: 123 - protein, 491 aa, Vibrio cholerae
VEDELNIFDECRSPCSLTPEPGKPIQSKLSIPGDVVLDEGVLYYSMTINDEQNDIKDEDKGESIITIGEFATVRATRHYVNQDAPFGVIHLDITTENGTKTYSFNRKEGEFAINWLVPIGEDSPASIKISIDELDQQRNIIEVPKLYSIDLDNQTLEQWETQGNVSFAVTRPEQSIAISWPSVSYKAAEKDGARHKRWAHWHTGLALCWLVPLDAIYNYITQQNCTLGDNWFGGSYETVAGTPKAITVKQGMEQKPVEQRIHFSKKNAMEALAAHRVCGVPLETLARGRKPRDLTDDLQCAYQAQNIVSLFLATRILFSHLDSVFTLNLDEQEPEVAERLTDLRRINENNPGMVTQVLTIARQIYNDYVTEHPGLTPEQTSAGAQAADILSLFCPDADESCVASNSDQANINIESRSGRSYLPENRAVITPQGVTNWTYQELEAKHQTLTREGYVFVGYHGTNHVAAQSIVNRITPVPRGNNTEKEEEWGG

SEQ ID NO: 124 - protein, 488 aa, Vibrio cholerae
YSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSNGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 125 - protein, 459 aa, Vibrio cholerae
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQKRNIIEVPKLYSIDLDNQTLEQWENQGNVSFAVTRPEQSIAISWPSVSYKAAHKNGSRHKRWANWLTTLPKVVLCFYEEPELCTYGEDWHGGAYKTVAGTPEAITVKQGIEQKTVEQRIHFSKKNAMEALAAHRVCGVPLETLARSRKPRDLQDDLSCAYQAQNIVSLFVATRILFSHLDSVFTLNLDEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHV

SEQ ID NO: 126 - protein, 415 aa, Artificial Sequence
  Description of Artificial Sequence: Synthetic polypeptide
VEEALNIFDECRSPCSLTPEPGKPIQSKLSIPGDVVLDEGVLYYSMTINDEQNDIKDEDKGESIITIGEFATVRATRHYVSQDAPFGVINLDITTENGTKTYSFNRKESEFAINWLVPIGEDSPASIKISIDELDQQRNIIEVPKLYSIDLDNQTLEQWKTQGNVSFSVTRPEHNIAISWPSVSYKAAQKEGSRHKRWAHWHTGLALCWLVPIDAIYNYITQQNCTLGDNWFGGSYETVAGTPKAITVKQGIEQKPVEQRIHFSKKNAMEALAAHRVCGVPLETLARSRKPRDLPDDLSCAYNAQQIVSLFLATRILFTHIDSIFTLNLDGQEPEVAERLDDLRRINENNPGMVIQVLTVARQIYNDYVTHHPGLTPEQTSAGAQAADILSLFCPDADKSCVASNSDQANINIES

SEQ ID NO: 127 - protein, 318 aa, Vibrio cholerae
LFSHLDSVFTLNLHEQEPAVAERLSALRQINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISAKPPYKERKDELK

SEQ ID NO: 128 - protein, 208 aa, Vibrio cholerae
AVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDELK

SEQ ID NO: 129 - protein, 207 aa, Vibrio cholerae
AVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDETVIGWDMAIHAVAIPSTIPGNAYEELAIDEEAVAKEQSISTKPPYKERKDEL

SEQ ID NO: 130 - protein, 649 aa, Artificial Sequence
  Description of Artificial Sequence: Synthetic polypeptide
  MOD_RES (1)..(1): V or L
  MOD_RES (3)..(3): E or D
  MOD_RES (4)..(4): A or E
  MOD_RES (6)..(6): N or K
  MOD_RES (16)..(16): S or L
  MOD_RES (21)..(21): P or L
  MOD_RES (24)..(24): P or Q
  MOD_RES (30)..(30): S or F
  MOD_RES (33)..(33): S or G
  MOD_RES (56)..(56): K or M
  MOD_RES (59)..(59): D or G
  MOD_RES (67)..(67): I or F
  MOD_RES (73)..(73): V or I
  MOD_RES (81)..(81): N or S
  MOD_RES (90)..(90): H or N
  MOD_RES (101)..(101): T or M
  MOD_RES (104)..(104): Y or F
  MOD_RES (108)..(108): E or D
  MOD_RES (109)..(109): G or S
  MOD_RES (112)..(112): A or T
  MOD_RES (114)..(114): N or H
  MOD_RES (118)..(118): P or I
  MOD_RES (119)..(119): I or P
  MOD_RES (131)..(131): V or I
  MOD_RES (134)..(134): L or I
  MOD_RES (137)..(137): Q or K
  MOD_RES (160)..(160): K or E
  MOD_RES (161)..(161): T or N
  MOD_RES (166)..(166): S or F
  MOD_RES (168)..(168): S or A
  MOD_RES (174)..(174): H or Q
  MOD_RES (175)..(185): This region may encompass one of the following sequences: "N", "S", "SIAKQS", or "SIAKQSIAKQS"
  MOD_RES (196)..(196): K or N
  MOD_RES (199)..(199): Q, E, or H
  MOD_RES (201)..(201): E, N, or D
  MOD_RES (203)..(203): S or A
  MOD_RES (210)..(210): H or N
  MOD_RES (212)..(212): H, L, F, or R
  MOD_RES (214)..(214): G or T
  MOD_RES (215)..(215): L or S
  MOD_RES (216)..(216): A or P
  MOD_RES (217)..(217): L, E, or K
  MOD_RES (218)..(218): C or V
  MOD_RES (219)..(219): W, V, or T
  MOD_RES (221)..(221): V or absent
  MOD_RES (222)..(222): P or absent
  MOD_RES (223)..(223): M, I, L, or absent
  MOD_RES (224)..(224): D or absent
  MOD_RES (225)..(225): A or absent
  MOD_RES (226)..(226): I or absent
  MOD_RES (227)..(227): Y or C
  MOD_RES (228)..(228): N or F
  MOD_RES (229)..(229): Y or F
  MOD_RES (230)..(230): I or E
  MOD_RES (231)..(231): T or D
  MOD_RES (232)..(232): Q or P
  MOD_RES (233)..(233): Q, E, or A
  MOD_RES (234)..(234): N, L, or Q
  MOD_RES (237)..(237): L or Y
  MOD_RES (239)..(239): D or E
  MOD_RES (240)..(240): N or D
  MOD_RES (242)..(242): F, H, or Y
  MOD_RES (245)..(245): S or A
  MOD_RES (247)..(247): E or K
  MOD_RES (252)..(252): T or I
  MOD_RES (254)..(254): K, E, or G
  MOD_RES (255)..(255): V or A
  MOD_RES (257)..(257): T or M
  MOD_RES (262)..(262): I or M
  MOD_RES (266)..(266): P, T, or A
  MOD_RES (275)..(275): K, Q, or N
  MOD_RES (276)..(276): G or K
  MOD_RES (279)..(279): M or I
  MOD_RES (280)..(280): S or E
  MOD_RES (281)..(281): A or T
  MOD_RES (298)..(298): S or G
  MOD_RES (303)..(303): D or Y
  MOD_RES (305)..(305): T, P, or Q
  MOD_RES (309)..(309): S or Q
  MOD_RES (311)..(311): A or V
  MOD_RES (313)..(313): Q or N
  MOD_RES (316)..(316): N or Q
  MOD_RES (322)..(322): V or L
  MOD_RES (326)..(326): I or M
  MOD_RES (329)..(329): S or T
  MOD_RES (331)..(331): L or I
  MOD_RES (334)..(334): V or I
  MOD_RES (340)..(340): D, E, or H
  MOD_RES (341)..(341): E or G
  MOD_RES (343)..(343): E or A
  MOD_RES (345)..(345): E or A
  MOD_RES (347)..(347): A or T
  MOD_RES (351)..(351): S, D, or T
  MOD_RES (352)..(352): D or A
  MOD_RES (353)..(353): L or I
  MOD_RES (355)..(355): R or Q
  MOD_RES (359)..(359): N or D
  MOD_RES (363)..(363): M or V
  MOD_RES (365)..(365): T or I
  MOD_RES (370)..(370): V or I
  MOD_RES (381)..(381): H or E
  MOD_RES (384)..(384): G or L
  MOD_RES (386)..(386): T or I
  MOD_RES (393)..(393): G or S
  MOD_RES (403)..(403): F or L
  MOD_RES (404)..(404): C or Y
  MOD_RES (407)..(407): A or T
  MOD_RES (409)..(409): K, E, or G
  MOD_RES (410)..(410): S, P, or H
  MOD_RES (414)..(414): S or L
  MOD_RES (415)..(415): N or D
  MOD_RES (416)..(416): N or S
  MOD_RES (423)..(423): I or V
  MOD_RES (433)..(433): P or L
  MOD_RES (441)..(441): P or Q
  MOD_RES (453)..(453): E or D
  MOD_RES (454)..(454): A or T
  MOD_RES (455)..(455): T or K
  MOD_RES (458)..(458): A or T
  MOD_RES (461)..(461): R or Q
  MOD_RES (463)..(463): G or D
  MOD_RES (475)..(475): V or A
  MOD_RES (479)..(479): T, S, or N
  MOD_RES (485)..(485): A, S, or T
  MOD_RES (491)..(491): N or S
  MOD_RES (492)..(492): N or D
  MOD_RES (495)..(495): N, S, or K
  MOD_RES (497)..(497): E, R, or K
  MOD_RES (498)..(498): K, A, or E
  MOD_RES (502)..(502): L or V
  MOD_RES (505)..(505): A or S
  MOD_RES (507)..(507): H or D
  MOD_RES (509)..(509): E or S
  MOD_RES (510)..(510): V or L
  MOD_RES (511)..(511): A or N
  MOD_RES (512)..(512): H or Y
  MOD_RES (513)..(513): G or R
  MOD_RES (515)..(515): A or T
  MOD_RES (517)..(517): I or L
  MOD_RES (518)..(518): K or Q
  MOD_RES (519)..(519): E or K
  MOD_RES (522)..(522): G or A
  MOD_RES (523)..(523): E, D, or N
  MOD_RES (524)..(524): Y, G, A, or N
  MOD_RES (525)..(525): G or E
  MOD_RES (526)..(526): L or G
  MOD_RES (527)..(527): P or L
  MOD_RES (529)..(529): R, P, or T
  MOD_RES (530)..(530): A or E
  MOD_RES (531)..(531): E or K
  MOD_RES (532)..(532): R, Q, or K
  MOD_RES (533)..(533): D, K, or E
  MOD_RES (534)..(534): A, T, or S
  MOD_RES (540)..(540): R or K
  MOD_RES (543)..(543): I or L
  MOD_RES (544)..(544): P or H
  MOD_RES (545)..(545): R or Q
  MOD_RES (554)..(554): T or I
  MOD_RES (556)..(556): T, A, or I
  MOD_RES (557)..(557): P or D
  MOD_RES (560)..(560): N or K
  MOD_RES (561)..(561): A or E
  MOD_RES (562)..(562): E, R, or D
  MOD_RES (563)..(563): E, N, or R
  MOD_RES (564)..(564): H or L
  MOD_RES (565)..(565): I or V
  MOD_RES (566)..(566): T or E
  MOD_RES (567)..(567): Q, R, H, or D
  MOD_RES (572)..(572): S or P
  MOD_RES (583)..(583): P or T
  MOD_RES (584)..(584): E or D
  MOD_RES (585)..(585): S, A, or R
  MOD_RES (586)..(586): A, E, or V
  MOD_RES (587)..(587): G, E, or D
  MOD_RES (589)..(589): E or S
  MOD_RES (590)..(590): D or N
  MOD_RES (593)..(593): V or A
  MOD_RES (598)..(598): M or I
  MOD_RES (601)..(601): H or Y
  MOD_RES (602)..(602): A or G
  MOD_RES (613)..(613): A or S
  MOD_RES (615)..(615): E or A
  MOD_RES (616)..(616): E, A, Q, G, V, or R
  MOD_RES (618)..(618): A, P, or T
  MOD_RES (619)..(619): I, T, or P
  MOD_RES (620)..(620): D or A
  MOD_RES (624)..(629): This region may encompass one of the following sequences: "V" or "VVKEAI"
  MOD_RES (631)..(631): K or E
  MOD_RES (637)..(637): T, A, or P
  MOD_RES (644)..(644): R, Q, or H
  MOD_RES (645)..(645): K or absent
  See specification as filed for detailed description of substitutions and preferred embodiments
XEXXLXIFDECRSPCXLTPEXGKXIQSKLXIPXDVVLDEGVLYYSMTINDEQNDIXDEXKGESIITXGEFATXRATRHYVXQDAPFGVIXLDITTENGTKXYSXNRKXXEFXIXWLVXXGEDSPASIKISXDEXDQXRNIIEVPKLYSIDLDNQTLEQWXXQGNVXFXVTRPEXXXXXXXXXXXXIAISWPSVSYXAAXKXGXRHKRWAXWXTXXXXXXLXXXXXXXXXXXXXXCTXGXXWXGGXYXTVAGXPXXIXVKQGXEQKXVEQRIHFSXXNAXXXLAAHRVCGVPLETLARXRKPRXLXDDLXCXYXAQXIVSLFXATRXLFXHXDSXFTLNLXXQXPXVXERLXXXRXINEXNPGXVXQVLTXARQIYNDYVTXHPXLXPEQTSAXAQAADILSLXXPDXDXXCVAXXXDQANINXESRSGRSYLXENRAVITXQGVTNWTYQELXXXHQXLTXEXYVFVGYHGTNHXAAQXIVNRIXPVPRGXXTEXEXXWGGXYVXTXAXXXXXYXRXXXGTXXXXXXTXXXXXXRGVMLXVYXXXASLERFYRXNXXLEXXXXXXXXVIGHXLPLRNEAFTGXXXXXGXXETXIGWDXAIXXVAIPSTIPGNXYXXLXXXEEAXXXXXXAXEQSISXKPPYKEXXDELK

SEQ ID NO: 131 - protein, 207 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLA

SEQ ID NO: 132 - protein, 246 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKV

SEQ ID NO: 133 - protein, 252 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQG

SEQ ID NO: 134 - protein, 267 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKG

SEQ ID NO: 135 - protein, 387 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQA

SEQ ID NO: 136 - protein, 188 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKA

SEQ ID NO: 137 - protein, 148 aa, Artificial Sequence
  Description of Artificial Sequence: Synthetic polypeptide
MVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKA

SEQ ID NO: 138 - protein, 167 aa, Artificial Sequence
  Description of Artificial Sequence: Synthetic polypeptide
MGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGL

SEQ ID NO: 139 - protein, 152 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDL

SEQ ID NO: 140 - protein, 135 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDEL

SEQ ID NO: 141 - protein, 179 aa, Artificial Sequence
  Description of Artificial Sequence: Synthetic polypeptide
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 142 - protein, 146 aa, Artificial Sequence
  Description of Artificial Sequence: Synthetic polypeptide
APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 143 - protein, 147 aa, Artificial Sequence
  Description of Artificial Sequence: Synthetic polypeptide
MAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 144 - protein, 178 aa, Artificial Sequence
  Description of Artificial Sequence: Synthetic polypeptide
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 145 - protein, 160 aa, Artificial Sequence
  Description of Artificial Sequence: Synthetic polypeptide
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 146 - protein, 191 aa, Artificial Sequence [sequence omitted]

SEQ ID NO: 147 - protein, 428 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGGGGGSGGGGSGGGGSAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 148 - protein, 548 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAGGGGSGGGGSGGGGSAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 149 - protein, 561 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAGGGGSGGGGSGGGGSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 150 - protein, 473 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGGGGGSNLQGGLRQPRFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 151 - protein, 341 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 152 - protein, 358 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 153 - protein, 394 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 154 - protein, 354 aa, Artificial Sequence
  Description of Artificial Sequence: Synthetic polypeptide
MVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 155 - protein, 413 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLAGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 156 - protein, 379 aa, Artificial Sequence
  Description of Artificial Sequence: Synthetic polypeptide
MGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFHHHHHH

SEQ ID NO: 157 - protein, 452 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 158 - protein, 458 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 159 - protein, 473 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGGGGGSGGGGSGGGGSFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 160 - protein, 9 aa, Artificial Sequence
  Description of Artificial Sequence: Synthetic peptide
LTPEPGKPI

SEQ ID NO: 161 - protein, 7 aa, Artificial Sequence
  Description of Artificial Sequence: Synthetic peptide
TRPEHNI

SEQ ID NO: 162 - protein, 17 aa, Artificial Sequence
  Description of Artificial Sequence: Synthetic peptide
KAAQKEGSRHKRWAHWH

SEQ ID NO: 163 - protein, 9 aa, Artificial Sequence
  Description of Artificial Sequence: Synthetic peptide
IPSDVVLDE

SEQ ID NO: 164 - protein, 5 aa, Artificial Sequence
  Description of Artificial Sequence: Synthetic peptide
DQQRN

SEQ ID NO: 165 - protein, 17 aa, Artificial Sequence
  Description of Artificial Sequence: Synthetic peptide
DQQRNIIEVPKLYSIDL

SEQ ID NO: 166 - protein, 40 aa, Artificial Sequence
  Description of Artificial Sequence: Synthetic polypeptide
VEEALNIFDECRSPCSLTPEPGKPIQSKLSIPSDVVLDEG

SEQ ID NO: 167 - protein, 37 aa, Artificial Sequence
  Description of Artificial Sequence: Synthetic polypeptide
LDNQTLEQWKTQGNVSFSVTRPEHNIAISWPSVSYKA

SEQ ID NO: 168 - protein, 19 aa, Artificial Sequence
  Description of Artificial Sequence: Synthetic peptide
AQKEGSRHKRWAHWHTGLA

SEQ ID NO: 169 - protein, 30 aa, Artificial Sequence
  Description of Artificial Sequence: Synthetic polypeptide
  MISC_FEATURE (1)..(30): This sequence may encompass 1-15 "Gly Ser" repeating units
GSGSGSGSGSGSGSGSGSGSGSGSGSGSGS

SEQ ID NO: 170 - protein, 45 aa, Artificial Sequence
  Description of Artificial Sequence: Synthetic polypeptide
  MISC_FEATURE (1)..(45): This sequence may encompass 1-15 "Gly Gly Ser" repeating units
GGSGGSGGSGGSGGSGGSGGSGGSGGSGGSGGSGGSGGSGGSGGS

SEQ ID NO: 171 - protein, 60 aa, Artificial Sequence
  Description of Artificial Sequence: Synthetic polypeptide
  MISC_FEATURE (1)..(60): This sequence may encompass 1-15 "Gly Gly Gly Ser" repeating units
GGGSGGGSGGGSGGGSGGGSGGGSGGGSGGGSGGGSGGGSGGGSGGGSGGGSGGGSGGGS

SEQ ID NO: 172 - protein, 75 aa, Artificial Sequence
  Description of Artificial Sequence: Synthetic polypeptide
  MISC_FEATURE (1)..(75): This sequence may encompass 1-15 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGS

SEQ ID NO: 173 - protein, 90 aa, Artificial Sequence
  Description of Artificial Sequence: Synthetic polypeptide
  MISC_FEATURE (1)..(90): This sequence may encompass 1-15 "Gly Gly Gly Gly Gly Ser" repeating units
GGGGGSGGGGGSGGGGGSGGGGGSGGGGGSGGGGGSGGGGGSGGGGGSGGGGGSGGGGGSGGGGGSGGGGGSGGGGGSGGGGGSGGGGGS

SEQ ID NO: 174 - protein, 25 aa, Artificial Sequence
  Description of Artificial Sequence: Synthetic peptide
  MISC_FEATURE (1)..(25): This sequence may encompass 1-5 "Gly Gly Gly Gly Ser" repeating units
GGGGSGGGGSGGGGSGGGGSGGGGS

SEQ ID NO: 175 - protein, 15 aa, Artificial Sequence
  Description of Artificial Sequence: Synthetic peptide
GGGGSGGGGSGGGGS

SEQ ID NO: 176 - protein, 14 aa, Artificial Sequence
  Description of Artificial Sequence: Synthetic peptide
GGGGSGGGGSGGGG

SEQ ID NO: 177 - protein, 15 aa, Artificial Sequence
  Description of Artificial Sequence: Synthetic peptide
GGGGSNLQGGLRQPR

SEQ ID NO: 178 - protein, 266 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSK

SEQ ID NO: 179 - protein, 348 aa, Artificial Sequence
  Description of Artificial Sequence: Synthetic polypeptide
VEDELNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINE

SEQ ID NO: 180 - protein, 386 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQA

SEQ ID NO: 181 - protein, 266 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKG

SEQ ID NO: 182 - protein, 251 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQG

SEQ ID NO: 183 - protein, 245 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKV

SEQ ID NO: 184 - protein, 206 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLA

SEQ ID NO: 185 - protein, 4 aa, Artificial Sequence
  Description of Artificial Sequence: Synthetic peptide
VEEA

SEQ ID NO: 186 - protein, 4 aa, Artificial Sequence
  Description of Artificial Sequence: Synthetic peptide
VLYY

SEQ ID NO: 187 - protein, 5 aa, Artificial Sequence
  Description of Artificial Sequence: Synthetic peptide
GVLYY

SEQ ID NO: 188 - protein, 428 aa, Artificial Sequence
  Description of Artificial Sequence: Synthetic polypeptide
MLEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGGGGGSGGGGSGGGGSAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 189 - protein, 633 aa, Artificial Sequence
  Description of Artificial Sequence: Synthetic polypeptide
VEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESRSGRSYLPENRAVITPQGVTNWTYQELEATHQALTREGYVFVGYHGTNHVAAQTIVNRIAPVPRGNNTENEEKWGGLYVATHAEVAHGYARIKEGTGEYGLPTRAERDARGVMLRVYIPRASLERFYRTNTPLENAEEHITQVIGHSLPLRNEAFTGPESAGGEDTVIGWDMAIHAVAIPSTIPGNAYEELAIDEEAVAKEQSISTKPPYKERKDELK

SEQ ID NO: 190 - protein, 192 aa, Artificial Sequence
  Description of Artificial Sequence: Synthetic polypeptide
MFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 191 - protein, 422 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESCENLFQ

SEQ ID NO: 192 - protein, 393 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQACENLFQ

SEQ ID NO: 193 - protein, 432 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAADILSLFCPDADKSCVASNNDQANINIESCENLFQSGTCHHHHHH

SEQ ID NO: 194 - protein, 403 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQACENLFQSGTCHHHHHH

SEQ ID NO: 195 - protein, 39 aa, Artificial Sequence
  Description of Artificial Sequence: Synthetic polypeptide
HGEGTFTSDLSKQMEEEAVRLFIEWLKNGGPSSGAPPPS

SEQ ID NO: 196 - protein, 5 aa, Artificial Sequence
  Description of Artificial Sequence: Synthetic peptide
GGGGS

SEQ ID NO: 197 - protein, 25 aa, Artificial Sequence
  Description of Artificial Sequence: Synthetic peptide
GGGGSGGGGSGGGGSGGGGSGGGGS

SEQ ID NO: 198 - protein, 418 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGGGGGSAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 199 - protein, 438 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGGGGGSGGGGSGGGGSGGGGSGGGGSAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 200 - protein, 418 aa, Artificial Sequence
  Description of Artificial Sequence: Synthetic polypeptide
MAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACIGGGGSVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKG

SEQ ID NO: 201 - protein, 538 aa, Artificial Sequence
  Description of Artificial Sequence: Synthetic polypeptide
MVEEALNIFDECRSPCSLTPEPGKPIQSKLSIPSDVVLDEGVLYYSMTINDEQNDIKDEDKGESIITIGEFATVRATRHYVNQDAPFGVIHLDITTENGTKTYSYNRKEGEFAINWLVPIGEDSPASIKISVDELDQQRNIIEVPKLYSIDLDNQTLEQWKTQGNVSFSVTRPEHNIAISWPSVSYKAAQKEGSRHKRWAHWHTGLALCWLVPMDAIYNYITQQNCTLGDNWFGGSYETVAGTPKVITVKQGIEQKPVEQRIHFSKGNAMSALAAHRVCGVPLETLARSRKPRDLTDDLSCAYQAQNIVSLFVATRILFSHLDSVFTLNLDEQEPEVAERLSDLRRINENNPGMVTQVLTVARQIYNDYVTHHPGLTPEQTSAGAQAGGGGSAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 202 - protein, 6 aa, Artificial Sequence
  Description of Artificial Sequence: Synthetic peptide
SIAKQS

SEQ ID NO: 203 - protein, 11 aa, Artificial Sequence
  Description of Artificial Sequence: Synthetic peptide
SIAKQSIAKQS

SEQ ID NO: 204 - protein, 6 aa, Artificial Sequence
  Description of Artificial Sequence: Synthetic peptide
VVKEAI

SEQ ID NO: 205 - protein, 6 aa, Artificial Sequence
  Description of Artificial Sequence: Synthetic 6xHis tag
HHHHHH

What is claimed is:

1. An isolated carrier comprising:
   an at least 206 amino acids-long amino acid sequence having at least 90% sequence identity to amino acid residues 1-206 of SEQ ID NO: 2 and having leucine at a position that corresponds to the amino acid residue 1 of the 1-206 amino acid residues of SEQ ID NO: 2, wherein the carrier is capable of transcytosis across a polarized epithelial cell.

2. The carrier of claim 1, wherein the polarized epithelial cell is a gastrointestinal polarized epithelial cell.

3. The carrier of claim 1, further comprising an N-terminal methionine.

4. The carrier of claim 1, coupled to a heterologous payload.

5. The carrier of claim 4, wherein the heterologous payload is covalently coupled to the carrier.

6. The carrier of claim 4, wherein the heterologous payload is coupled to the carrier via a spacer.

7. The carrier of claim 4, wherein the heterologous payload is covalently coupled to the carrier via a spacer.

8. The carrier of claim 4, wherein the heterologous payload is noncovalently coupled to the carrier.

9. The carrier of claim 4, wherein the heterologous payload is a polypeptide.

10. The carrier of claim 4, wherein the heterologous payload is a therapeutic payload.

11. The carrier of claim 4, wherein the carrier is non-toxic.

12. The carrier of claim 1, wherein the carrier comprises a glutamic acid at position 3 and an alanine at position 4.

13. The carrier of claim 1, wherein the carrier lacks ADP ribosylation activity.

14. The carrier of claim 1, wherein the at least 206 amino acids-long amino acid sequence has at least 95% sequence identity to amino acid residues 1-206 of SEQ ID NO: 2.

15. A pharmaceutical formulation comprising a carrier-payload complex, wherein the carrier-payload complex comprises:
   (a) a carrier comprising an at least 206 amino acids-long amino acid sequence having at least 90% sequence identity to amino acid residues 1-206 of SEQ ID NO: 2 and having leucine at a position that corresponds to the amino acid residue 1 of the 1-206 amino acid residues of SEQ ID NO: 2, wherein the carrier is coupled to
   (b) a heterologous payload,
   wherein the pharmaceutical formulation is formulated for oral administration.

16. The pharmaceutical formulation of claim 15, wherein the carrier comprises a glutamic acid at position 3 and an alanine at position 4.

* * * * *